United States Patent 10,501,513 (MODIFIED POLYNUCLEOTIDES FOR THE PRODUCTION OF ONCOLOGY-RELATED PROTEINS AND PEPTIDES) - sequence listing, part 6

SEQ ID NO: 6123 - protein, 682 aa, Homo sapiens
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 6124 - protein, 760 aa, Homo sapiens
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 6125 - protein, 916 aa, Homo sapiens
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIREKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAEVVSKGKGKK

SEQ ID NO: 6126 - protein, 904 aa, Homo sapiens
MAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRYFLIYGGSTEEQRYLTALRKEKEAFEKLIREKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAEVVSKGKGKK

SEQ ID NO: 6127 - protein, 356 aa, Homo sapiens
MAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKIKKKKKK

SEQ ID NO: 6128 - protein, 1186 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 6129 - protein, 419 aa, Homo sapiens
MFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 6130 - protein, 1018 aa, Homo sapiens
MNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 6131 - protein, 1611 aa, Homo sapiens
QGAVKSFCTSASGAPLGPKGDGHYPWSCPVTHTREKIYAICSDYAFLNQATSIYKTPNPSRSPCLPDSTSLSAGNNSSRYIGIPTSTSEIIYNEENSLENLSNSLGKLPLAWEIDKSEFDGVTTNSKHKSGNAKKQVSKRKTSDKKGRYQKECPQHSPLEDIKQRKVLDLRRWYCISRPQYKTSCGISSLISCWNFLYSTMGAGNLPPITQEEALHILGFQPPFEDIRFGPFTGNTTLMRWFRQINDHFHVKGCSYVLYKPHGKNKTAGETASGALSKLTRGLKDESLAYIYHCQNHYFCPIGFEATPVKANKAFSRGPLSPQEVEYWILIGESSRKHPAIHCKKWADIVTDLNTQNPEYLDIRHLERGLQYRKTKKVGGNLHCIIAFQRLNWQRFGLWNFPFGTIRQESQPPTHAQGIAKSESEDNISKKQHGRLGRSFSASFHQDSAWKKMSNISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 6132 - protein, 232 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEVYLPLLQP

SEQ ID NO: 6133 - protein, 1493 aa, Homo sapiens
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRFEGLGPTVIVCPTTVMHQWVKEFHTWWPPFRVAILHETGSYTHKKEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 6134 - protein, 870 aa, Homo sapiens
QQPFHRHLLMTTALHSEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 6135 - protein, 179 aa, Homo sapiens
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKY

SEQ ID NO: 6136 - protein, 105 aa, Homo sapiens
MSLSLPDKNEQVLFCRLTDEQHKVYQNFVDSKEVYRILNGEMQEVLQSFTSIHLHESPLNFFRSFQVRGSRSHYPGKGMQTTLGIVNFLVVTLKRKKRNRFSPDL

SEQ ID NO: 6137 - protein, 863 aa, Homo sapiens
MQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 6138 - protein, 396 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 6139 - protein, 338 aa, Homo sapiens
MLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 6140 - protein, 395 aa, Homo sapiens
MATSSAPAGVRTRYAGVFVRTPNGFGGPSSPSESRVNTESFGTGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 6141 - protein, 243 aa, Homo sapiens
MGYKYITIGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 6142 - protein, 846 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 6143 - protein, 169 aa, Homo sapiens
MGIQGLLQFIKEASEPIHVRKYKGQVVAVDTYCWLHKGAIACAEKLAKGEPTDRRRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDV

SEQ ID NO: 6144 - protein, 846 aa, Homo sapiens; identical to SEQ ID NO: 6142

SEQ ID NO: 6145 - protein, 135 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIK

SEQ ID NO: 6146 - protein, 803 aa, Homo sapiens
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKF

SEQ ID NO: 6147 - protein, 11 aa, Homo sapiens
MGIQGLLQFIK

SEQ ID NO: 6148 - protein, 746 aa, Homo sapiens
MQAKKRYFILLSAGSCLALLFYFGGLQFRASRSHSRREEHSGRNGLHHPSPDHFWPRFPDALRPFVPWDQLENEDSSVHISPRQKRDANSSIYKGKKCRMESCFDFTLCKKNGFKVYVYPQQKGEKIAESYQNILAAIEGSRFYTSDPSQACLFVLSLDTLDRDQLSPQYVHNLRSKVQSLHLWNNGRNHLIFNLYSGTWPDYTEDVGFDIGQAMLAKASISTENFRPNFDVSIPLFSKDHPRTGGERGFLKFNTIPPLRKYMLVFKGKRYLTGIGSDTRNALYHVHNGEDVVLLTTCKHGKDWQKHKDSRCDRDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVMSSRFLPYDNIITDAVLSLDEDTVLSTTEVDFAFTVWQSFPERIVGYPARSHFWDNSKERWGYTSKWTNDYSMVLTGAAIYHKYYHYLYSHYLPASLKNMVDQLANCEDILMNFLVSAVTKLPPIKVTQKKQYKETMMGQTSRASRWADPDHFAQRQSCMNTFASWFGYMPLIHSQMRLDPVLFKDQVSILRKKYRDIERL

SEQ ID NO: 6149 - protein, 718 aa, Homo sapiens
MCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 6150 - protein, 728 aa, Homo sapiens
MCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQLFMEPARRENWSAANHQMNSLIWPREQWDSQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 6151 - protein, 751 aa, Homo sapiens
MSCASGSGGGLRHPLRCQKPWDEECEEEAVCVIMCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 6152 - protein, 112 aa, Homo sapiens
MCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALK

SEQ ID NO: 6153 - protein, 49 aa, Homo sapiens
MCASVKYNIRGPALIPRMKTKHRIYYITLFSIVLLGLIATGMFQFWPHS

SEQ ID NO: 6154 - protein, 718 aa, Homo sapiens; identical to SEQ ID NO: 6149

SEQ ID NO: 6155 - protein, 586 aa, Homo sapiens
MPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 6156 - protein, 586 aa, Homo sapiens; identical to SEQ ID NO: 6155

SEQ ID NO: 6157 - protein, 554 aa, Homo sapiens
MPKPINVRVTTMDAELEFAIQPNTTGKQLFDQVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 6158 - protein, 299 aa, Homo sapiens
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 6159 - protein, 299 aa, Homo sapiens; identical to SEQ ID NO: 6158

SEQ ID NO: 6160 - protein, 299 aa, Homo sapiens; identical to SEQ ID NO: 6158

SEQ ID NO: 6161 - protein, 303 aa, Homo sapiens
MLQAPRGRARAALRRLAVATRTMAGGSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 6162 - protein, 250 aa, Homo sapiens
MGTKAQVERKLLCLFILAILLCSLALGSVTVHSSEPEVRIPENNPVKLSCAYSGFSSPRVEWKFDQGDTTRLVCYNNKITVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 6163 - protein, 1118 aa, Homo sapiens
MGVQGFQDYIEKHCPSAVVPVELQKLARGSLVGGGRQRPPQTPLRLLVDADNCLHRLYGGFYTDWVSGGQWNHMLGYLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVCGFGGPYGETVATGPYRAFRVAAASGHCGAFSGSDSSRTSKSQGGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 6164 - protein, 1146 aa, Homo sapiens
MGVQGFQDYIEKHCPSAVVPVELQKLARGSLVGGGRQRPPQTPLRLLVDADNCLHRLYGGFYTDWVSGGQWNHMLGYLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATKPFQLYLQKNFVFHKENSIVLCSRILRHGHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVCGFGGPYGETVATGPYRAFRVAAASGHCGAFSGSDSSRTSKSQGGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 6165 - protein, 1072 aa, Homo sapiens
MGVQGFQDYIEKHCPSAVVPVELQKLARGSLVGGGRQRPPQTPLRLLVDADNCLHRLYGGFYTDWVSGGQWNHMLGYLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 6166 - protein, 628 aa, Homo sapiens
MGVQGFQDYIEKHCPSAVVPVELQKLARGSLVGGGRQRPPQTPLRLLVDADNCLHRLYGGFYTDWVSGGQWNHMLGYLAALAKACFGGNIELFVFFNGALEKARLHEWVKRQGNERQTAQQIVSHVQNKGTPPPKVWFLPPVCMAHCIRLALIRFHVKVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKVLSKGPWSGFCYLMSGHSYGCFVLLSFFEPFFCLTNLLETKFTFPFLNIE

SEQ ID NO: 6167 - protein, 494 aa, Homo sapiens
GEIKIAVSIEDEANKDLPPAALLYRPVRQYVYGVLFSLAESRKKTERLAFRKNRLPPEFSPVIIKEWAAYKGKSPQTPELVEALAFREWTCPNLKRLWLGKAVEDKNRRMRAFLACMRSDTPAMLNPANVPTHLMVLCCVLRYMVQWPGARILRRQELDAFLAQALSPKLYEPDQLQELKIENLDPRGIQLSALFMSGVDMALFANDACGQPIPWEHCCPWMYFDGKLFQSKLLKASREKTPLIDLCDGQADQAAKVEKMRQSVLEGLSFSRQSHTLPFPPPPALPFYPASAYPRHFGPVPPSQGRGRGFAGVQPIPSQGGKLEIAGTVVGHWAGSRRGRGGRGPFPLQVVSVGGPARGRPRGVISTPVIRTFGRGGRYYGRGYKNQAAIQGRPPYAASAEEVAKELKSKSGESKSSAMSSDGSLAENGVMAEEKPAPQMNGSTGDARAPSHSESALNNDSKTCNTNPHLNALSTDSACRREAALEAAVLNKEE

SEQ ID NO: 6168 - protein, 494 aa, Homo sapiens
  MOD_RES (1)..(1): Any amino acid
XVAQSIEDHHQEVIGFCRENGFHGLVAYDSDYALCNIPYYFSAHALKLSRNGKSLTTSQYLMHEVAKQLDLNPNRFPIFAALLGNHILPDEDLASFHWSLLGPEHPLASLKVRAHQLVLPPCDVVIKAVADYVRNIQDTSDLDAIAKDVFQHSQSRTDDKVIRFKRAIGYYSATSKPMSFHPPHYLAARPGPFGMPGMVPPHVPPQMLNIPQTSLQAKPVAPQVPSPGGAPGQGPYPYSLSEPAPLTLDTSGKNLTEQNSYSNIPHEGKHTPLYERSSPINPAQSGSPNHVDSAYFPGSSTSSSSDNDEGSGGATNHISGNKIGWEKTGSHSEPQARGDPGDQTKAEGSSTASSGSQLAEGKGSQMGTVQPIPCLLSMPTRNHMDITTPPLPPVAPEVLRVAEHRHKKGLMYPYIFHVLTKGEIKIAVSIEDEANKDLPPAALLYRPVRQYVYGVLFSLAESRKKTERLAFRKNRLPPECMYCNNPLFVFLGTS

SEQ ID NO: 6169 - protein, 322 aa, Homo sapiens
MVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESGKKHAAEAQMRRAALFRGILQMVKNEPSLRFLAK

SEQ ID NO: 6170 - protein, 1455 aa, Homo sapiens
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPGKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 6171 - protein, 297 aa, Homo sapiens
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRC

SEQ ID NO: 6172 - protein, 302 aa, Homo sapiens
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRASAARS

SEQ ID NO: 6173 - protein, 265 aa, Homo sapiens
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRC

SEQ ID NO: 6174 - protein, 622 aa, Homo sapiens
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQGLQELITGNPDKALSSLHEAASGLCPRPVLVQVYTALGSCHRKMGNPQRALLYLVAALKEGSAWGPPLLEASRLYQQLGDTTAELESLELLVEALNVPCSSKAPQFLIEVELLLPPPDLASPLHCGTQSQTKHILASRCLQTGRAGDAAEHYLDLLALLLDSSEPRFSPPPSPPGPCMPEVFLEAAVALIQAGRAQDALTLCEELLSRTSSLLPKMSRLWEDARKGTKELPYCPLWVSATHLLQGQAWVQLGAQKVAISEFSRCLELLFRATPEEKEQGAAFNCEQGCKSDAALQQLRAAALISRGLEWVASGQDTKALQDFLLSVQMCPGNRDTYFHLLQTLKRLDRRDEATALWWRLEAQTKGSHEDALWSLPLYLESYLSWIRPSDRDAFLEEFRTSLPKSCDL

SEQ ID NO: 6175 - protein, 215 aa, Homo sapiens
MSRQTTSVGSSCLDLWREKNDRLVRQAKVAQNSGLTLRRQQLAQDALEGLRGLLHSLQGLPAAVPVLPLELTVTCNFIILRASLAQGFTEDQAQDIQRSLERVLETQEQQGPRLEQGLRELWDSVLRASCLLPELLSALHRLVGLQAALWLSADRLGDLALLLETLNGSQSGASKDLLLLLKTWSPPAEELDAPLTLQDAQGLKDVLLTAFAYRQ

SEQ ID NO: 6176 - protein, 448 aa, Homo sapiens [sequence omitted]

SEQ ID NO: 6177 - protein, 220 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPMLT

SEQ ID NO: 6178 - protein, 335 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 6179 - protein, 314 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 6180 - protein, 244 aa, Homo sapiens
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYHHYCWSHDTKSS

SEQ ID NO: 6181 - protein, 362 aa, Homo sapiens
MLRVCAQGWHAQGLPHGTNSLLKGGTETSLSTPTRLVVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPVGIEIDFSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 6182 - protein, 208 aa, Homo sapiens
MDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 6183 - protein, 127 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELREATPVHPLKKRS

SEQ ID NO: 6184 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 6185 - protein, 4590 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVPAHLTVMVRDQDVPVKRNFARIVVNVSDTNDHAPWFTASSYKGRVYESAAVGSVVLQVTALDKDKGKNAEVLYSIESGTFGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 6186 - protein, 4588 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 6187 - protein, 488 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAV

SEQ ID NO: 6188 - protein, 132 aa, Homo sapiens
MCDAFVGTWKLVSSENFDDYMKEVGVGFATRKVAGMAKPNMIISVNGDVITIKSESTFKNTEISFILGQEFDEVTADDRKVKSTITLDGGVLVHVQKWDGKSTTIKRKREDDKLVVECVMKGVTSTRVYERA

SEQ ID NO: 6189 - protein, 2511 aa, Homo sapiens
MEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIAAVPATAMPFRGYAVLGGERGGPEVQQVPAGERPLWFICSGMGTQWRGMGLSLMRLDRFRDSILRSDEAVKPFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPGVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIGRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARALGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 6190 - protein, 833 aa, Homo sapiens
MSILGSAKHGLYLPTRVTAIHIDPATHRQKLYTLQDKAQVADVVVSRWLRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQAKASQAWPCSGAPSATWAFWWRR

SEQ ID NO: 6191 - protein, 380 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 6192 - protein, 321 aa, Homo sapiens
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 6193 - protein, 320 aa, Homo sapiens
MNPPSQEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 6194 - protein, 374 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 6195 - protein, 240 aa, Homo sapiens
MWFLTTLLLWGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSG

SEQ ID NO: 6196 - protein, 822 aa, Homo sapiens
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSLPPPLQLIPEVQKPLHEQLWYHGAIPRAEVAELLVHSGDFLVRESQGKQEYVLSVLWDGLPRHFIIQSLDNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 6197 - protein, 764 aa, Homo sapiens
MGFSSELCSPQGHGVLQQMQEAELRLLEGMRKWMAQRVKSDREYAGLLHHMSLQDSGGQSRAISPDSPISQTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSLPPPLQLIPEVQKPLHEQLWYHGAIPRAEVAELLVHSGDFLVRESQGKQEYVLSVLWDGLPRHFIIQSLDNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 6198 - protein, 681 aa, Homo sapiens
MGFSSELCSPQGHGVLQQMQEAELRLLEGMRKWMAQRVKSDREYAGLLHHMSLQDSGGQSRAISPDSPISQTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARSSPSTSSWSLCRGSSPPAGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 6199 - protein, 694 aa, Homo sapiens
MGFSSELCSPQGHGVLQQMQEAELRLLEGMRKWMAQRVKSDREYAGLLHHMSLQDSGGQSRAISPDSPISQTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 6200 - protein, 42 aa, Homo sapiens
MGFSSELCSPQGHGVLQQMQEAELRLLEGMRKWMAQRVKSDR

SEQ ID NO: 6201 - protein, 115 aa, Homo sapiens
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKT

SEQ ID NO: 6202 - protein, 752 aa, Homo sapiens
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSNLYRLEGEGFPSIPLLIDHLLSTQQPLTKKSGVVLHRAVPKDKWVLNHEDLVLGEQIGRGNFGEVFSGRLRADNTLVAVKSCRETLPPDLKAKFLQEARILKQYSHPNIVRLIGVCTQKQPIYIVMELVQGGDFLTFLRTEGARLRVKTLLQMVGDAAAGMEYLESKCCIHRDLAARNCLVTEKNVLKISDFGMSREEADGVYAASGGLRQVPVKWTAPEALNYGRYSSESDVWSFGILLWETFSLGASPYPNLSNQQTREFVEKGGRLPCPELCPDAVFRLMEQCWAYEPGQRPSFSTIYQELQSIRKRHR

SEQ ID NO: 6203 - protein, 694 aa, Homo sapiens; identical to SEQ ID NO: 6199

SEQ ID NO: 6204 - protein, 147 aa, Homo sapiens
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALAR

SEQ ID NO: 6205 - protein, 545 aa, Homo sapiens
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALARDSAQAKRKYQEASKDKDRDKAKDKYVRSLWKLFAHHNRYVLGVRAAQLHHQHHHQLLLPGLLRSLQDLHEEMACILKEILQEYLEISSLVQDEVVAIHREMAAAAARIQPEAEYQGFLRQYGSAPDVPPCVTFDESLLEEGEPLEPGELQLNELTVESVQHTLTSVTDELAVATEMVFRRQEMVTQLQQELRNEEENTHPRERVQLLGKRQVLQEALQGLQVALCSQAKLQAQQELLQTKLEHLGPGEPPPVLLLQDDRHSTSSSEQEREGGRTPTLEILKSHISGIFRPKFSLPPPLQLIPEVQKPLHEQLWYHGAIPRAEVAELLVHSGDFLVRESQGKQEYVLSVLWDGLPRHFIIQAHAPSEWRLLTPGPLPCRTCTDWKGKAFLAFLCSSTTY

SEQ ID NO: 6206 - protein, 121 aa, Homo sapiens
MGFSSELCSPQGHGVLQQMQEAELRLLEGMRKWMAQRVKSDREYAGLLHHMSLQDSGGQSRAISPDSPISQVGLYGTLVGAGCICLLLPLLGALWGSGWRSGRPMLGSHCAPLPASPICAV

SEQ ID NO: 6207 - protein, 169 aa, Homo sapiens
MGFSSELCSPQGHGVLQQMQEAELRLLEGMRKWMAQRVKSDREYAGLLHHMSLQDSGGQSRAISPDSPISQSWAEITSQTEGLSRLLRQHAEDLNSGPLSKLSLLIRERQQLRKTYSEQWQQLQQELTKTHSQDIEKLKSQYRALARDSAQAKRKYQEASKDKDRDKAK

SEQ ID NO: 6208 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 6209 - protein, 735 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 6210 - protein, 155 aa, Homo sapiens
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 6211 - protein, 155 aa, Homo sapiens; identical to SEQ ID NO: 6210

SEQ ID NO: 6212 - protein, 155 aa, Homo sapiens; identical to SEQ ID NO: 6210

SEQ ID NO: 6213 - protein, 58 aa, Homo sapiens
MAEGEITTFTALTEKFNLPPGNYKKPKLLYCSNGGHFLRILPDGTVDGTRDRSDQHIQ

SEQ ID NO: 6214 - protein, 41 aa, Homo sapiens
MAEGEITTFTALTEKFNLPPGNYKKPKLLYCSNGGHFLRIL

SEQ ID NO: 6215 - protein, 155 aa, Homo sapiens; identical to SEQ ID NO: 6210

SEQ ID NO: 6216 - protein, 155 aa, Homo sapiens; identical to SEQ ID NO: 6210

SEQ ID NO: 6217 - protein, 60 aa, Homo sapiens
MAEGEITTFTALTEKFNLPPGNYKKPKLLYCSNGGHFLRILPDGTVDGTRDRSDQHTDTK

SEQ ID NO: 6218 - protein, 208 aa, Homo sapiens
MWKWILTHCASAFPHLPGCCCCCFLLLFLVSSVPVTCQALGQDMVSPEATNSSSSSFSSPSSAGRHVRSYNHLQGDVRWRKLFSFTKYFLKIEKNGKVSGTKKENCPYSILEITSVEIGVVAVKAINSNYYLAMNKKGKLYGSKEFNNDCKLKERIEENGYNTYASFNWQHNGRQMYVALNGKGAPRRGQKTRRKNTSAHFLPMVVHS

SEQ ID NO: 6219 - protein, 66 aa, Homo sapiens
MWKWILTHCASAFPHLPGCCCCCFLLLFLVSSVPVTCQALGQDMVSPEATNSSSSSFSSPSSAGRH

SEQ ID NO: 6220 - protein, 288 aa, Homo sapiens
LVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 6221 - protein, 194 aa, Homo sapiens
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 6222 - protein, 194 aa, Homo sapiens; identical to SEQ ID NO: 6221

SEQ ID NO: 6223 - protein, 234 aa, Homo sapiens [sequence omitted]

SEQ ID NO: 6224 - protein, 234 aa, Homo sapiens [sequence omitted]

SEQ ID NO: 6225 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 6226 - protein, 170 aa, Homo sapiens
EYLDLSAPFEQYSPGGQDTPSSSSSGDDSVFAHDLLATGPQQCEGSLAAHPAAGAQPLPGMRLSADGETATQSFGLCVCVCVCVCCTSACACVRAHLASRCRGTLGVPAAVQRSPDWCCSTEGPLFWGDPVQNVSGPTRWDPGQGAGPDMRPLPLHHGTSQGLGPSHTQS

SEQ ID NO: 6227 - protein, 808 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 6228 - protein, 694 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 6229 - protein, 806 aa, Homo sapiens; identical to SEQ ID NO: 6225

SEQ ID NO: 6230 - protein, 792 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNLVLWGPALGDLHAGGLPVPRHPCGGALQAAEGGPPHGQARQLHTRPVHDHAGVLACRALPEAHLQAAGGGPGPCPYRDVHRRVPGPVGAFRAVLPGWPGHPQLQLLRGRLRVCPRPAAPGPTQQWGLADVKGHWSPTM

SEQ ID NO: 6231 - protein, 802 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 6232 - protein, 762 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPGTGRIPHLTCDSLTPAGRTKSPTLQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 6233 - protein, 1030 aa, Homo sapiens
PCMWHQQHVPCVCVCPYVCVCMRVCVCVCWPLSCALNAVCVTCPKSVAFALGVASAACGCVGVKEWWLLQHALQSACALHVRCVLCTQEAASDGAAGSADLCPLPTEPCLAPSLEQQEQELTVALGQPVRLCCGRAERGGHWYKEGSRLAPAGRVRGWRGRLEIASFLPEDAGRYLCLARGSMIVLQNLTLITGDSPPATMMRTPSPIGTPRIGTVTPSKVSRSPRTCVPAAAHLITEKRRPVWEHTVILGAFPCPPAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPGEHLKGQEMLRDAPLGQQWGLWPVGWSVSVGLWGLAWGAVCGFVGLSCMTAPLCLSTRGRPCDRLLRCGCLGLGITTASSVCVPTYVGSWEGLGCTGRPVSPLTSLSVCVCPCARAEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 6234 - protein, 762 aa, Homo sapiens; identical to SEQ ID NO: 6232

SEQ ID NO: 6235 - protein, 802 aa, Homo sapiens; identical to SEQ ID NO: 6231

SEQ ID NO: 6236 - protein, 201 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIR

SEQ ID NO: 6237 - protein, 87 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLE

SEQ ID NO: 6238 - protein, 108 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMI

SEQ ID NO: 6239 - protein, 114 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLT

SEQ ID NO: 6240 - protein, 2387 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6241 - protein, 2446 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6242 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6243 - protein, 2184 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6244 - protein, 2211 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNVIVEALKDQQRHKVREEVVTVGNSGWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6245 - protein, 2477 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6246 - protein, 2296 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6247 - protein, 2031 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQSTKA

SEQ ID NO: 6248 - protein, 2176 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6249 - protein, 2386 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6250 - protein, 2240 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6251 - protein, 657 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 6252 - protein, 2267 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6253 - protein, 2265 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6254 - protein, 2330 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6255 - protein, 1103 aa, Homo sapiens
LRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6256 - protein, 103 aa, Homo sapiens
MPVSVSSGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 6257 - protein, 108 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 6258 - protein, 103 aa, Homo sapiens; identical to SEQ ID NO: 6256

SEQ ID NO: 6259 - protein, 108 aa, Homo sapiens; identical to SEQ ID NO: 6257

SEQ ID NO: 6260 - protein, 92 aa, Homo sapiens
MGVQVETISPGDGMLEDGKKFDSSRDRNKPFKFMLGKQEVIRGWEEGVAQMSVGQRAKLTISPDYAYGATGHPGIIPPHATLVFDVELLKLE

SEQ ID NO: 6261 - protein, 380 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 6262 - protein, 165 aa, Homo sapiens
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAA

SEQ ID NO: 6263 - protein, 1338 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 6264 - protein, 176 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKKNKRA

SEQ ID NO: 6265 - protein, 541 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKLPPANSSFMLPPTSFSSNYFHFLP

SEQ ID NO: 6266 - protein, 556 aa, Homo sapiens
MKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 6267 - protein, 14 aa, Homo sapiens
ELSNFECLHPCSQE

SEQ ID NO: 6268 - protein, 733 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPELYTSTSPSSSSSSPLSSSSSSSSSSSS

SEQ ID NO: 6269 - protein, 361 aa, Homo sapiens
MNSDLLVDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 6270 - protein, 24 aa, Homo sapiens
LPPANSSFMLPPTSFSSNYFHFLP

SEQ ID NO: 6271 - protein, 235 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 6272 - protein, 178 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPVETVFHRVSQDGLDLLTS

SEQ ID NO: 6273 - protein, 235 aa, Homo sapiens; identical to SEQ ID NO: 6271

SEQ ID NO: 6274 - protein, 1363 aa, Homo sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFSCKGPGQNVAVTRAHPDSQGRRRRPERGARGGQVFYNSEYGELSEPSEEDHCSPSARVTFFTDNSY

SEQ ID NO: 6275 - protein, 760 aa, Homo sapiens
MLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKGVGSAGGRGSLAGEEQQLGVGRWDGNSGRETEAGSQSHPRFYREAAGFRAEGPPEPPSVGPAGCPGGP

SEQ ID NO: 6276 - protein, 1298 aa, Homo sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFR

SEQ ID NO: 6277 - protein, 1306 aa, Homo sapiens
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFRGTRRTRGA

SEQ ID NO: 6278 - protein, 579 aa, Homo sapiens
MNAIVALCHFCELHGPRTLFCTEVLHAPLPQGDGNEDSPGQGEQAEEEEGGIQMNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALKVFEAEQFGCPQRAQRMNTAFTPFLHQRNGNAARSLTSLTSDDNLWACLHTSFAWLLKACGSRLTEKLLEGAPTEDTLVQMEKLADLEEESESWDNSEAEEEEKAPVLPESTEGRELTQGPAESSSLSGCGSWQPRKLPVFKSLRHMRQVLGAPSFRMLAWHVLMGNQVIWKSRDVDLVQSAFEVLRTMLPVGCVRIIPYSSQYEEAYRCNFLGLSPHVQIPPHVLSSEFAVIVEVHAAARSTLHPVGCEDDQSLSKYEFVVTSGSPVAADRVGPTILNKIEAALTNQNLSVDVVDQCLVCLKEEWMNKVKVLFKFTKVDSRPKEDTQKLLSILGASEEDNVKLLKFWMTGLSKTYKSHLMSTVRSPTASESRN

SEQ ID NO: 6279 - protein, 197 aa, Homo sapiens
MNAIVALCHFCELHGPRTLFCTEVLHAPLPQGDGNEDSPGQGEQAEEEEGGIQMNSRMRAHSPAEGASVESSSPGPKKSDMCEGCRSLAAGHPGYISHDKETSIKYVSHQHPSHPQLFSIVRQACVRSLSCEVSLVATEPVSVGAHMLPGALGGLGASIAQGGRHWSSLRADPQISTAQGTGRLPCPELREESCWTC

SEQ ID NO: 6280 - protein, 342 aa, Homo sapiens
MNAIVALCHFCELHGPRTLFCTEVLHAPLPQGDGNEDSPGQGEQAEEEEGGIQMNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALKVFEAEQFGCPQRAQRMNTAFTPFLHQRNGNAARSLTSLTSDDNLWACLHTSFAWLLKACGSRLTEKLLEGAPTEDTLVQMEKLAGEAGVLLPGPWPGWPWGGTSCLLSWQESLREGNAALNQPRTSLREAHPPISV

SEQ ID NO: 6281 - protein, 197 aa, Homo sapiens; identical to SEQ ID NO: 6279

SEQ ID NO: 6282 - protein, 153 aa, Homo sapiens
MNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALK

SEQ ID NO: 6283 - protein, 472 aa, Homo sapiens
MLGTVKMEGHETSDWNSYYADTQEAYSSVPVSNMNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPAASPQTLDHSGATATGGASELKTPASSTAPPISSGPGALASVPASHPAHGLAPHESQLHLKGDPHYSFNHPFSINNLMSSSEQQHKLDFKAYEQALQYSPYGSTLPASLPLGSASVTTRSPIEPSALEPAYYQGVYSRPVLNTS

SEQ ID NO: 6284 - protein, 439 aa, Homo sapiens
MNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPAASPQTLDHSGATATGGASELKTPASSTAPPISSGPGALASVPASHPAHGLAPHESQLHLKGDPHYSFNHPFSINNLMSSSEQQHKLDFKAYEQALQYSPYGSTLPASLPLGSASVTTRSPIEPSALEPAYYQGVYSRPVLNTS

SEQ ID NO: 6285 - protein, 501 aa, Homo sapiens
MQARYSVSDPNALGVVPYLSEQNYYRAAGSYGGMASPMGVYSGHPEQYSAGMGRSYAPYHHHQPAAPKDLVKPPYSYIALITMAIQNAPEKKITLNGIYQFIMDRFPFYRENKQGWQNSIRHNLSLNECFVKVPRDDKKPGKGSYWTLDPDSYNMFENGSFLRRRRRFKKKDVSKEKEERAHLKEPPPAASKGAPATPHLADAPKEAEKKVVIKSEAASPALPVITKVETLSPESALQGSPRSAASTPAGSPDGSLPEHHAAAPNGLPGFSVENIMTLRTSPPGGELSPGAGRAGLVVPPLALPYAAAPPAAYGQPCAQGLEAGAAGGYQCSMRAMSLYTGAERPAHMCVPPALDEALSDHPSGPTSPLSALNLAAGQEGALAATGHHHQHHGHHHPQAPPPPPAPQPQPTPQPGAAAAQAASWYLNHSGDLNHLPGHTFAAQQQTFPNVREMFNSHRLGIENSTLGESQVSGNASCQLPYRSTPPLYRHAAPYSYDCTKY

SEQ ID NO: 6286 - protein, 655 aa, Homo sapiens
MAEAPQVVEIDPDFEPLPRPRSCTWPLPRPEFSQSNSATSSPAPSGSAAANPDAAAGLPSASAAAVSADFMSNLSLLEESEDFPQAPGSVAAAVAAAAAAAATGGLCGDFQGPEAGCLHPAPPQPPPPGPLSQHPPVPPAAAGPLAGQPRKSSSSRRNAWGNLSYADLITKAIESSAEKRLTLSQIYEWMVKSVPYFKDKGDSNSSAGWKNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQASHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 6287 - protein, 673 aa, Homo sapiens
MAEAPASPAPLSPLEVELDPEFEPQSRPRSCTWPLQRPELQASPAKPSGETAADSMIPEEEDDEDDEDGGGRAGSAMAIGGGGGSGTLGSGLLLEDSARVLAPGGQDPGSGPATAAGGLSGGTQALLQPQQPLPPPQPGAAGGSGQPRKCSSRRNAWGNLSYADLITRAIESSPDKRLTLSQIYEWMVRCVPYFKDKGDSNSSAGWKNSIRHNLSLHSRFMRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 6288 - protein, 673 aa, Homo sapiens; identical to SEQ ID NO: 6287

SEQ ID NO: 6289 - protein, 433 aa, Homo sapiens
MRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMSMGAWNVTWSPLSVVNSWMLMGWILTLIPSSPHRMLLV

SEQ ID NO: 6290 - protein, 453 aa, Homo sapiens
MRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 6291 - protein, 147 aa, Homo sapiens
MSFRFGQHLIKPSVVFLKTELSFALVNRKPVVPGHVLVCPLRPVERFHDLRPDEVADLFQTTQRVGTVVEKHFHGTSLTFSMQDGPEAGQTVKHVHVHVLPRKAGDFHRNDSIYEELQKHDKEDFPASWRSEEEMAAEAAALRVYFQ

SEQ ID NO: 6292 - protein, 147 aa, Homo sapiens; identical to SEQ ID NO: 6291

SEQ ID NO: 6293 - protein, 147 aa, Homo sapiens; identical to SEQ ID NO: 6291

SEQ ID NO: 6294 - protein, 79 aa, Homo sapiens
MSFRFGQHLIKPSVVFLKTELSFALVNRKPVVPGHVLVCPLRPVERFHDLRPDEVADLFQTTQRVGTVVEKHFHGTSLT

SEQ ID NO: 6295 - protein, 147 aa, Homo sapiens; identical to SEQ ID NO: 6291

SEQ ID NO: 6296 - protein, 574 aa, Homo sapiens
MRDPGAAAPLSSLGLCALVLALLGALSAGAGAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGPGGGPTAYPTAPYLPDLPFTALPPGASDGRGRPAFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 6297 - protein, 258 aa, Homo sapiens
MAEYSYVKSTKLVLKGTKTKSKKKKSKDKKRKREEDEETQLDIVGIWWTVTNFGEISGTIAIEMDKGTYIHALDNGLFTLGAPHKEVDEGPSPPEQFTAVKLSDSRIALKSGYGKYLGINSDGLVVGRSDAIGPREQWEPVFQNGKMALLASNSCFIRCNEAGDIEAKSKTAGEEEMIKIRSCAERETKKKDDIPEEDKGNVKQCEINYVKKFQSFQDHKLKISKEDSKILKKARKDGFLHETLLDRRAKLKADRYCK

SEQ ID NO: 6298 - protein, 510 aa, Homo sapiens
MYRALRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 6299 - protein, 178 aa, Homo sapiens
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNRCR

SEQ ID NO: 6300 - protein, 107 aa, Homo sapiens
MQTLSNIPCFCLHGSLLPSTDLATLSAHPTDDTTTLSERPSPSTDVQTDPQTLKPSGFHEDDPFFYDEHTLRKRGLLVAAVLFITGIIILTSGKCRQLSRLCRNRCR

SEQ ID NO: 6301 - protein, 96 aa, Homo sapiens
MSPSGRLCLLTIVGLILPTRGQTLKDTTSSSSADSTIMDIQVPTRAPDAVYTELQPTSPTPTWPADGAYITAYGVTHFLMNMLAVSSFFCLHTAPQ

SEQ ID NO: 6302 - protein, 178 aa, Homo sapiens; identical to SEQ ID NO: 6299

SEQ ID NO: 6303 - protein, 178 aa, Homo sapiens; identical to SEQ ID NO: 6299

SEQ ID NO: 6304 - protein, 178 aa, Homo sapiens; identical to SEQ ID NO: 6299

SEQ ID NO: 6305 - protein, 194 aa, Homo sapiens
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSENWGWVGRTPRPGGGLMTEGWVLKGPWAILF

SEQ ID NO: 6306 - protein, 505 aa, Homo sapiens
MSNICQRLWEYLEPYLPCLSTEADKSTVIENPGALCSPQSQRHGHYFVALFDYQARTAEDLSFRAGDKLQVLDTLHEGWWFARHLEKRRDGSSQQLQGYIPSNYVAEDRSLQAEPWFFGAIGRSDAEKQLLYSENKTGSFLIRESESQKGEFSLSVLDGAVVKHYRIKRLDEGGFFLTRRRIFSTLNEFVSHYTKTSDGLCVKLGKPCLKIQVPAPFDLSYKTVDQWEIDRNSIQLLKRLGSGQFGEVWEGLWNNTTPVAVKTLKPGSMDPNDFLREAQIMKNLRHPKLIQLYAVCTLEDPIYIITELMRHGSLQEYLQNDTGSKIHLTQQVDMAAQVASGMAYLESRNYIHRDLAARNVLVGEHNIYKVADFGLARVFKVDNEDIYESRHEIKLPVKWTAPEAIRSNKFSIKSDVWSFGILLYEIITYGKMPYSGMTGAQVIQMLAQNYRLPQPSNCPQQFYNIMLECWNAEPKERPTFETLRWKLEDYFETDSSYSDANNFIR

SEQ ID NO: 6307 - protein, 363 aa, Homo sapiens
MDSTSLLPNPWIRVLDGAVVKHYRIKRLDEGGFFLTRRRIFSTLNEFVSHYTKTSDGLCVKLGKPCLKIQVPAPFDLSYKTVDQWEIDRNSIQLLKRLGSGQFGEVWEGLWNNTTPVAVKTLKPGSMDPNDFLREAQIMKNLRHPKLIQLYAVCTLEDPIYIITELMRHGSLQEYLQNDTGSKIHLTQQVDMAAQVASGMAYLESRNYIHRDLAARNVLVGEHNIYKVADFGLARVFKVDNEDIYESRHEIKLPVKWTAPEAIRSNKFSIKSDVWSFGILLYEIITYGKMPYSGMTGAQVIQMLAQNYRLPQPSNCPQQFYNIMLECWNAEPKERPTFETLRWKLEDYFETDSSYSDANNFIR

SEQ ID NO: 6308 - protein, 375 aa, Homo sapiens
MRSVAPSGPKMGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEPELLTKLHPAFQTPNSPGSGGFPTGRLA

SEQ ID NO: 6309 - protein, 338 aa, Homo sapiens
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEP

SEQ ID NO: 6310 - protein, 365 aa, Homo sapiens
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEPELLTKLHPAFQTPNSPGSGGFPTGRLA

SEQ ID NO: 6311 - protein, 365 aa, Homo sapiens; identical to SEQ ID NO: 6310

SEQ ID NO: 6312 - protein, 699 aa, Homo sapiens
MTLRRKCNEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSAWRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 6313 - protein, 739 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSAWRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 6314 - protein, 382 aa, Homo sapiens
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 6315 - protein, 366 aa, Homo sapiens
MGDWSALGKLLDKVQAYSTAGGKVWLSAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 6316 - protein, 217 aa, Homo sapiens
MSFRGGGRGGFNRGGGGGGFNRGGSSNHFRGGGGGGGGGNFRGGGRGGFGRGGGRGGFNKGQDQGPPERVVLLGEFLHPCEDDIVCKCTTDENKVPYFNAPVYLENKEQIGKVDEIFGQLRDFYFSVKLSENMKASSFKKLQKFYIDPYKLLPLQRFLPRPPGEKGPPRGGGRGGRGGGRGGGGRGGGRGGGFRGGRGGGGGGFRGGRGGGFRGRGH

SEQ ID NO: 6317 - protein, 217 aa, Homo sapiens; identical to SEQ ID NO: 6316

SEQ ID NO: 6318 - protein, 529 aa, Homo sapiens
MGCVFCKKLEPVATAKEDAGLEGDFRSYGAADHYGPDPTKARPASSFAHIPNYSNFSSQAINPGFLDSGTIRGVSGIGVTLFIALYDYEARTEDDLTFTKGEKFHILNNTEGDWWEARSLSSGKTGCIPSNYVAPVDSIQAEEWYFGKIGRKDAERQLLSPGNPQGAFLIRESETTKGAYSLSIRDWDQTRGDHVKHYKIRKLDMGGYYITTRVQFNSVQELVQHYMEVNDGLCNLLIAPCTIMKPQTLGLAKDAWEISRSSITLERRLGTGCFGDVWLGTWNGSTKVAVKTLKPGTMSPKAFLEEAQVMKLLRHDKLVQLYAVVSEEPIYIVTEFMCHGSLLDFLKNPEGQDLRLPQLVDMAAQVAEGMAYMERMNYIHRDLRAANILVGERLACKIADFGLARLIKDDEYNPCQGSKFPIKWTAPEAALFGRFTIKSDVWSFGILLTELITKGRIPYPGMNKREVLEQVEQGYHMPCPPGCPASLYEAMEQTWRLDPEERPTFEYLQSFLEDYFTSAEPQYQPGDQT

SEQ ID NO: 6319 - protein, 529 aa, Homo sapiens; identical to SEQ ID NO: 6318

SEQ ID NO: 6320 - protein, 529 aa, Homo sapiens; identical to SEQ ID NO: 6318

SEQ ID NO: 6321 - protein, 529 aa, Homo sapiens; identical to SEQ ID NO: 6318

SEQ ID NO: 6322 - protein, 313 aa, Homo sapiens
MGCVFCKKLEPVATAKEDAGLEGDFRSYGAADHYGPDPTKARPASSFAHIPNYSNFSSQAINPGFLDSGTIRGVSGIGVTLFIALYDYEARTEDDLTFTKGEKFHILNNTEGDWWEARSLSSGKTGCIPSNYVAPVDSIQAEEWYFGKIGRKDAERQLLSPGNPQGAFLIRESETTKGAYSLSIRDWDQTRGDHVKHYKIRKLDMGGYYITTRVQFNSVQELVQHYMEVNDGLCNLLIAPCTIMKPQTLGLAKDAWEISRSSITLERRLGTGCFGDVWLGTWNGSTKVAVKTLKPGTMSPKAFLEEAQVMKLL

SEQ ID NO: 6323 - protein, 463 aa, Homo sapiens [sequence omitted]

SEQ ID NO: 6324 - protein, 334 aa, Homo sapiens
MEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQHYCGGSAQLMRAQSMASRGGVVSFSSCSQNSGQPKSLGPRHPLA

SEQ ID NO: 6325 - protein, 413 aa, Homo sapiens
MEFPGLGSLGTSEPLPQFVDPALVSSTPESGVFFPSGPEGLDAAASSTAPSTATAAAAALAYYRDAEAYRHSPVFQVYPLLNCMEGIPGGSPYAGWAYGKTGLYPASTVCPTREDSPPQAVEDLDGKGSTSFLETLKTERLSPDLLTLGPALPSSLPVPNSAYGGPDFSSTFFSPTGSPLNSAAYSSPKLRGTLPLPPCEARECVNCGATATPLWRRDRTGHYLCNACGLYHKMNGQNRPLIRPKKRLIVSKRAGTQCTNCQTTTTTLWRRNASGDPVCNACGLYYKLHQVNRPLTMRKDGIQTRNRKASGKGKKKRGSSLGGTGAAEGPAGGFMVVAGGSGSGNCGEVASGLTLGPPGTAHLYQGLGPVVLSGPVSHLMPFPGPLLGSPTGSFPTGPMPPTTSTTVVAPLSS

SEQ ID NO: 6326 - protein, 122 aa, Homo sapiens
  MOD_RES (1)..(1): Any amino acid
XQNRPLIRPKKRLIVSKRAGTQCTNCQTTTTTLWRRNASGDPVCNACGLYYKLHQVNRPLTMRKDGIQTRNRKASGKGKKKRGSSLGGTGAAEGPALLWWLRSAHEGTEHGLQRRGGVLLLL

SEQ ID NO: 6327 - protein, 443 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 6328 - protein, 444 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTEGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 6329 - protein, 130 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLRPCLQCLWALLQASQC

SEQ ID NO: 6330 - protein, 265 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQATVTSVLEYLSNWFGERDFTPELGRWLYALLACLEKPLLPEAHSLIRQLARRCSEVRLLVDSKDDERVPALNLLICLVSRYFDQRDLADEPS

SEQ ID NO: 6331 - protein, 280 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVDSKDDERVPALNLLICLVSRYFDQRDLADEPS

SEQ ID NO: 6332 - protein, 250 aa, Homo sapiens
MRRAELAGLKTMAWVPAESAVEELMPRLLPVEPCDLTEGFDPSVPPRTPQEYLRRVQIEAAQCPDVVVAQIDPKKLKRKQSVNISLSGCQPAPEGYSPTLQWQQQQVAQFSTVRQNVNKHRSHWKSQQLDSNVTMPKSEDEEGWKKFCLGEKLCADGAVGPATNESPGIDYVQIGFPPLLSIVSRMNQATVTSVLEYLSNWFGERDFTPELGRWLYALLACLEKPLLPEAHSLIRQLARRCSEVRLLVVF

SEQ ID NO: 6333 - protein, 1106 aa, Homo sapiens
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 6334 - protein, 574 aa, Homo sapiens
LSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 6335 - protein, 129 aa, Homo sapiens
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTM

SEQ ID NO: 6336 - protein, 1065 aa, Homo sapiens
MFNSMTPPPISSYGEPCCLRPLPSQGAPSVGTEVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 6337 - protein, 175 aa, Homo sapiens
MSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKC

SEQ ID NO: 6338 - protein, 978 aa, Homo sapiens
MSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 6339 - protein, 44 aa, Homo sapiens
MSGPHSYGPARETNSCTEGPLFSSPRSAVKLTKKRALSISPLSD

SEQ ID NO: 6340 - protein, 1065 aa, Homo sapiens; identical to SEQ ID NO: 6336

SEQ ID NO: 6341 - protein, 515 aa, Homo sapiens [sequence omitted]

SEQ ID NO: 6342 - protein, 561 aa, Homo sapiens
MAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRGPGRQGGSGSESCSLSLGSLVWGPHALEPGEQGGELRRALASSVPRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 6343 - protein, 545 aa, Homo sapiens
MGRRGSAPGNGRTLRGCERGGRRRRSADSVMAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGIIRDVMQNHLLQMLCLVAMEKPASTNSDDVRDEKVKVLKCISEVQANNVVLGQYVGNPDGEGEATKGYLDDPTVPRGSTTATFAAVVLYVENERWDGVPFILRCGKALNERKAEVRLQFHDVAGDIFHQQCKRNELVIRVQPNEAVYTKMMTKKPGMFFNPEESELDLTYGNRYKNVKLPDAYERLILDVFCGSQMHFVRSDELREAWRIFTPLLHQIELEKPKPIPYIYGSRGPTEADELMKRVGFQYEGTYKWVNPHKL

SEQ ID NO: 6344 - protein, 515 aa, Homo sapiens [sequence omitted]

SEQ ID NO: 6345 - protein, 256 aa, Homo sapiens
MAEQVALSRTQVCGILREELFQGDAFHQSDTHIFIIMGASGDLAKKKIYPTIWWLFRDGLLPENTFIVGYARSRLTVADIRKQSEPFFKATPEEKLKLEDFFARNSYVAGQYDDAASYQRLNSHMNALHLGSQANRLFYLALPPTVYEAVTKNIHESCMSQIGWNRIIVEKPFGRDLQSSDRLSNHISSLFREDQIYRIDHYLGKEMVQNLMVLRFANRIFGPIWNRDNIACVILTFKEPFGTEGRGGYFDEFGII

SEQ ID NO: 6346 - protein, 226 aa, Homo sapiens
  MOD_RES (73)..(73): Selenocysteine
MARLLQASCLLSLLLAGFVSQSRGQEKSKMDCHGGISGTIYEYGALTIDGEEYIPFKQYAGKYVLFVNVASYCGLTGQYIELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 6347 - protein, 72 aa, Homo sapiens
MARLLQASCLLSLLLAGFVSQSRGQEKSKMDCHGGISGTIYEYGALTIDGEEYIPFKQYAGKYVLFVNVASY

SEQ ID NO: 6348 - protein, 210 aa, Homo sapiens
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVLAPGCLDAFPLLSAYVGRLSARPKLKAFLASPEYVNLPINGNGKQ

SEQ ID NO: 6349 - protein, 727 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 6350 - protein, 500 aa, Homo sapiens
MNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 6351 - protein, 727 aa, Homo sapiens; identical to SEQ ID NO: 6349

SEQ ID NO: 6352 - protein, 727 aa, Homo sapiens; identical to SEQ ID NO: 6349

SEQ ID NO: 6353 - protein, 109 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSS

SEQ ID NO: 6354 - protein, 727 aa, Homo sapiens; identical to SEQ ID NO: 6349

SEQ ID NO: 6355 - protein, 379 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEV

SEQ ID NO: 6356 - protein, 420 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 6357 - protein, 433 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKDSSGTGHFTSGVRVFRPRTPPEAIALCSRLLEYTPTARLTPLEACAHSFFDELRDPNVKLPNGRDTPALFNFTTQELSSNPPLATILIPPHARIQAAASTPTNATAASDANTGDRGQTNNAASASASNST

SEQ ID NO: 6358 - protein, 104 aa, Homo sapiens
MNPNYTEFKFPQIKAHPWTKVFRPRTPPEAIALCSRLLEYTPTARLTPLEACAHSFFDELRDPNVKLPNGRDTPALFNFTTQDANTGDRGQTNNAASASASNST

SEQ ID NO: 6359 - protein, 278 aa, Homo sapiens
MEENMEEGQTQKGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 6360 - protein, 278 aa, Homo sapiens; identical to SEQ ID NO: 6359

SEQ ID NO: 6361 - protein, 10 aa, Homo sapiens
MEENMEEGQT

SEQ ID NO: 6362 - protein, 267 aa, Homo sapiens
MGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 6363 - protein, 129 aa, Homo sapiens
MEENMEEGQTQKGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAW

SEQ ID NO: 6364 - protein, 271 aa, Homo sapiens
MTDLEGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 6365 - protein, 401 aa, Homo sapiens
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 6366 - protein, 401 aa, Homo sapiens; identical to SEQ ID NO: 6365

SEQ ID NO: 6367 - protein, 80 aa, Homo sapiens
MMGLGNGRRSMKSPPLVLAALVACIIVLGFNYWIASSRSVDLQTRIMELEGRVRRAAAERGAVELKKNEFQGELEKQREQ

SEQ ID NO: 6368 - protein, 121 aa, Homo sapiens
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQ

SEQ ID NO: 6369 - protein, 92 aa, Homo sapiens
MKPIQKLLAGLILLTWCVEGCSSQHWSYGLRPGGKRDAENLIDSFQEIVKEVGQLAETQRFECTTHQPRSPLRDLKGALESLIEEETGQKKI

SEQ ID NO: 6370 - protein, 92 aa, Homo sapiens; identical to SEQ ID NO: 6369

SEQ ID NO: 6371 - protein, 257 aa, Homo sapiens
MPASMFSIDNILAARPRCKDSVLPVAHSAAAPVVFPALHGDSLYGASGGASSDYGAFYPRPVAPGGAGLPAAVSGSRLGYNNYFYGQLHVQAAPVGPACCGAVPPLGAQQCSCVPTPPGYEGPGSVLVSPVPHQMLPYMNVGTLSRTELQLLNQLHCRRKRRHRTIFTDEQLEALENLFQETKYPDVGTREQLARKVHLREEKVEVWFKNRRAKWRRQKRSSSEESENAEKWNKTSSSKASPEKREEEGKSDLDSDS

SEQ ID NO: 6372 - protein, 217 aa, Homo sapiens
MAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 6373 - protein, 145 aa, Homo sapiens
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 6374 - protein, 130 aa, Homo sapiens
MEGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 6375 - protein, 184 aa, Homo sapiens
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 6376 - protein, 143 aa, Homo sapiens
MSRTAYTVGALLLLLGTLLPAAEGKKKGSQGAIPPPDKALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 6377 - protein, 143 aa, Homo sapiens; identical to SEQ ID NO: 6376

SEQ ID NO: 6378 - protein, 131 aa, Homo sapiens
MTLEEFSAGEQKTESDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 6379 - protein, 165 aa, Homo sapiens
MTLEEFSAGEQKTERMDKVGDALEEVLSKALSQRTITVGVYEAAKLLNVDPDNVVLCLLAADEDDDRDVALQIHFTLIQAFCCENDINILRVSNPGRLAELLLLETDAGPAASEGAEQPPDLHCVLVTNPHSSQWKDPALSQLICFCRESRYMDQWVPVINLPER

SEQ ID NO: 6380 - protein, 160 aa, Homo sapiens
MTLEELVACDNAAQKMQTVTAAVEELLVAAQRQDRLTVGVYESAKLMNVDPDSVVLCLLAIDEEEEDDIALQIHFTLIQSFCCDNDINIVRVSGMQRLAQLLGEPAETQGTTEARDLHCLLVTNPHTDAWKSHGLVEVASYCEESRGNNQWVPYISLQER

SEQ ID NO: 6381 - protein, 159 aa, Homo sapiens
MTLEEVRGQDTVPESTARMQGAGKALHELLLSAQRQGCLTAGVYESAKVLNVDPDNVTFCVLAAGEEDEGDIALQIHFTLIQAFCCENDIDIVRVGDVQRLAAIVGAGEEAGAPGDLHCILISNPNEDAWKDPALEKLSLFCEESRSVNDWVPSITLPE

SEQ ID NO: 6382 - protein, 141 aa, Homo sapiens
MQGAGKALHELLLSAQRQGCLTAGVYESAKVLNVDPDNVTFCVLAAGEEDEGDIALQIHFTLIQAFCCENDIDIVRVGDVQRLAAIVGAGEEAGAPGDLHCILISNPNEDAWKDPALEKLSLFCEESRSVNDWVPSITLPE

SEQ ID NO: 6383 - protein, 694 aa, Homo sapiens
MQPAIQVWFGEDLPLSPRSPLTPRHGPGLANVCQYDEWIAVRHEATLLPMQEDLSIWLSGLLGIKVKAEKLLEELDNGVLLCQLIDVLQNMVKTCNSEESGNFPMRKVPCKKDAASGSFFARDNTANFLHWCRDIGVDETYLFESEGLVLHKDPRQVYLCLLEIGRIVSRYGVEPPVLVKLEKEIELEETLLNTSGPEDSISIPKSCCRHEELHEAVKHIAEDPPCSCSHRFSIEYLSEGRYRLGDKILFIRMLHGKHVMVRVGGGWDTLQGFLLKYDPCRILQFATLEQKILAFQKGVSNESVPDSPARTPQPPEMNPLSAVNMFQKQNSKPSVPVSIPKSKEKQGRPPGALVPASSLKGGNLGSMSVRSKLPNSPAASSHPKLKSSKGITKKPQAPSNNASSSLASLNPVGKNTSSPALPRTAPCISESPRKCISSPNTPKAKVIPAQNSADLPESTLLPNKCSGKTQPKYLKHNHISSRDNAVSHLAAHSNSSSKCPKLPKANIPVRPKPSFQSSAKMTKTSSKTIATGLGTQSQPSDGAPQAKPVPAQKLKSALNLNQPVSVSSVSPVKATQKSKDKNIVSATKKQPQNKSAFQKTGPSSLKSPGRTPLSIVSLPQSSTKTQTAPKSAQTVAKSQHSTKGPPRSGKTPASIRKPPSSVKDADSGDKKPTAKKKEDDDHYFVMTGSKKPRK

SEQ ID NO: 6384 - protein, 694 aa, Homo sapiens; identical to SEQ ID NO: 6383

SEQ ID NO: 6385 - protein, 694 aa, Homo sapiens; identical to SEQ ID NO: 6383

SEQ ID NO: 6386 - protein, 49 aa, Homo sapiens
MQPAIQVWFGEDLPLSPRSPLTPRHGPGLANVCQYDEWIAVRHEATLLP

SEQ ID NO: 6387 - protein, 536 aa, Homo sapiens
MNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 6388 - protein, 548 aa, Homo sapiens
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 6389 - protein, 126 aa, Homo sapiens
MNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 6390 - protein, 536 aa, Homo sapiens; identical to SEQ ID NO: 6387

SEQ ID NO: 6391 - protein, 594 aa, Homo sapiens
MALAGCPDSFLHHPYYQDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 6392 - protein, 594 aa, Homo sapiens; identical to SEQ ID NO: 6391

SEQ ID NO: 6393 - protein, 536 aa, Homo sapiens; identical to SEQ ID NO: 6387

SEQ ID NO: 6394 - protein, 536 aa, Homo sapiens; identical to SEQ ID NO: 6387

SEQ ID NO: 6395 - protein, 588 aa, Homo sapiens
MQAAGPLFRSKDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAVRRLQEEDQQFRTSSLPAIPNPFPELCGPGSPPVLTPGSLPPSQAAAKQDVKVFSEDGTSKVVEILADMTARDLCQLLVYKSHCVDDNSWTLVEHHPHLGLERCLEDHELVVQVESTMASESKFLFRKNYAKYEFFKNPMNFFPEQMVTWCQQSNGSQTQLLQNFLNSSSCPEIQGFLHVKELGKKSWKKLYVCLRRSGLYCSTKGTSKEPRHLQLLADLEDSNIFSLIAGRKQYNAPTDHGLCIKPNKVRNETKELRLLCAEDEQTRTCWMTAFRLLKYGMLLYQNYRIPQQRKALLSPFSTPVRSVSENSLVAMDFSGQTGRVIENPAEAQSAALEEGHAWRKRSTRMNILGSQSPLHPSTLSTVIHRTQHWFHGRISREESHRIIKQQGLVDGLFLLRDSQSNPKAFVLTLCHHQKIKNFQILPCEDDGQTFFSLDDGNTKFSDLIQLVDFYQLNKGVLPCKLKHHCIRVAL

SEQ ID NO: 6396 - protein, 536 aa, Homo sapiens; identical to SEQ ID NO: 6387

SEQ ID NO: 6397 - protein, 536 aa, Homo sapiens; identical to SEQ ID NO: 6387

SEQ ID NO: 6398 - protein, 114 aa, Homo sapiens
MQAAGPLFRSKDKVEQTPRSQQDPAGPGLPAQSDRLANHQEDDVDLEALVNDMNASLESLYSACSMQSDTVPLLQNGQHARSQPRASGPPRSIQPQVSPRQRVQRSQPVHILAV

SEQ ID NO: 6399 - protein, 588 aa, Homo sapiens; identical to SEQ ID NO: 6395

SEQ ID NO: 6400 - protein, 176 aa, Homo sapiens
MEAIAKYDFKATADDELSFKRGDILKVLNEECDQNWYKAELNGKDGFIPKNYIEMKPHPFGNDVQHFKVLRDGAGKYFLWVVKFNSLNELVDYHRSTSVSRNQQIFLRDIEQVPQQPTYVQALFDFDPQEDGELGFRRGDFIHVMDNSDPNWWKGACHGQTGMFPRNYVTPVNRNV

SEQ ID NO: 6401 - protein, 217 aa, Homo sapiens [sequence omitted]

SEQ ID NO: 6402 - protein, 217 aa, Homo sapiens [sequence omitted]

SEQ ID NO: 6403 - protein, 217 aa, Homo sapiens [sequence omitted]

SEQ ID NO: 6404 - protein, 73 aa, Homo sapiens
MPALHIEDLPEKEKLKMEVEQLRKEVKLQRQQVSKCSEEIKNYIEERSGEDPLVKGIPEDKNPFKEKGSCVIS

SEQ ID NO: 6405 - protein, 143 aa, Homo sapiens
MSGRGKTGGKARAKAKSRSSRAGLQFPVGRVHRLLRKGHYAERVGAGAPVYLAAVLEYLTAEILELAGNAARDNKKTRIIPRHLQLAIRNDEELNKLLGGVTIAQGGVLPNIQAVLLPKKTSATVGPKAPSGGKKATQASQEY

SEQ ID NO: 6406 - protein, 143 aa, Homo sapiens; identical to SEQ ID NO: 6405

SEQ ID NO: 6407 - protein, 91 aa, Homo sapiens
MCPCPLHRGRGPPAVCACSAGRLGLRSSAAQLTAARLKALGDELHQRTMWRRRARSRRAPAPGALPTYWPWLCAAAQVAALAAWLLGRRNL

SEQ ID NO: 6408 - protein, 205 aa, Homo sapiens
MTERRVPFSLLRGPSWDPFRDWYPHSRLFDQAFGLPRLPEEWSQWLGGSSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 6409 - protein, 170 aa, Homo sapiens
MTERRVPFSLLRGPSWPGYVRPLPPAAIESPAVAAPAYSRALSRQLSSGVSEIRHTADRWRVSLDVNHFAPDELTVKTKDGVVEITGKHEERQDEHGYISRCFTRKYTLPPGVDPTQVSSSLSPEGTLTVEAPMPKLATQSNEITIPVTFESRAQLGGPEAAKSDETAAK

SEQ ID NO: 6410 - protein, 641 aa, Homo sapiens
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETAGGVMTALIKRNSTIPTKQTQIFTTYSDNQPGVLIQVYEGERAMTKDNNLLGRFDLTGIPPAPRGVPQIEVTFDIDANGILNVTAMDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELKQMCNPIITKLYQGGCTGPACGTGYVPGRPATGPTIEEVD

SEQ ID NO: 6411 - protein, 532 aa, Homo sapiens [sequence omitted]

SEQ ID NO: 6412 - protein, 641 aa, Homo sapiens; identical to SEQ ID NO: 6410

SEQ ID NO: 6413 - protein, 232 aa, Homo sapiens
AKGIAIGIDLGTTYSCVGVFQHGKVEIIANDQGNRTTPSYVAFTDTERLIGDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKGAPPASPRCSGCFRTTSMDVI

SEQ ID NO: 6414 - protein, 732 aa, Homo sapiens
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 6415 - protein, 854 aa, Homo sapiens
MPPCSGGDGSTPPGPSLRDRDCPAQSAEYPRDRLDPRPGSPSEASSPPFLRSRAPVNWYQEKAQVFLWHLMVSGSTTLLCLWKQPFHVSAFPVTASLAFRQSQGAGQHLYKDLQPFILLRLLMPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 6416 - protein, 413 aa, Homo sapiens
MGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVCEYSIS

SEQ ID NO: 6417 - protein, 803 aa, Homo sapiens
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 6418 - protein, 553 aa, Homo sapiens
MRALWVLGLCCVLLTFGSVRADDEVDVDGTVEEDLGKSREGSRTDDEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 6419 - protein, 315 aa, Homo sapiens [sequence omitted]

SEQ ID NO: 6420 - protein, 288 aa, Homo sapiens
MERPQPDSMPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMNSLEMTPAVRQRVIEEAKTAFLLNIQLFEELQELLTHDTKDQSPSRAPGLRQRASNKVQDSAPVETPRGKPPLNTRSQAPLLRWVLTLSFLVATVAVGLYAM

SEQ ID NO: 6421 - protein, 187 aa, Homo sapiens
MERPQPDSMPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMN

SEQ ID NO: 6422 - protein, 526 aa, Homo sapiens
LGGRSSCEDPGCPRDEERAPRMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 6423 - protein, 525 aa, Homo sapiens
LGGRSSCEDPGCPRDEERAPRMGCMKSKFLQVGGNTFSKTETSASPHCPVYVPDPTSTIKPGPNSHNSNTPGIREGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 6424 - protein, 504 aa, Homo sapiens
MGCMKSKFLQVGGNTFSKTETSASPHCPVYVPDPTSTIKPGPNSHNSNTPGIREGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 6425 - protein, 505 aa, Homo sapiens
MGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 6426 - protein, 506 aa, Homo sapiens
MMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 6427 - protein, 505 aa, Homo sapiens; identical to SEQ ID NO: 6425

SEQ ID NO: 6428 - protein, 543 aa, Homo sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 6429 - protein, 543 aa, Homo sapiens; identical to SEQ ID NO: 6428

SEQ ID NO: 6430 - protein, 97 aa, Homo sapiens
MLLLLGPLGPLSPGALPRPAQAQDVVDLDFFTQEPLHLVSPSFLSVTRPGKKVWLGETSSAYGGGAPLLSDTFAAGFMWLDKLGLSARMGIEVVMRQ

SEQ ID NO: 6431 - protein, 469 aa, Homo sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 6432 - protein, 485 aa, Homo sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSKPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 6433 - protein, 353 aa, Homo sapiens
MEKTLETVPLERKKREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 6434 - protein, 341 aa, Homo sapiens
MEREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 6435 - protein, 353 aa, Homo sapiens; identical to SEQ ID NO: 6433

SEQ ID NO: 6436 - protein, 249 aa, Homo sapiens [sequence omitted]

SEQ ID NO: 6437 - protein, 281 aa, Homo sapiens
MSEEQFGGDGAAGNGGGRRAGEQEGAMVAATQGAAAREAEPGPGAEPRLEAPKGAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 6438 - protein, 355 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 6439 - protein, 336 aa, Homo sapiens
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 6440 - protein, 306 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 6441 - protein, 155 aa, Homo sapiens
MSEEQFGGDGAAAAATAAVGGSAGEQEGAMVAATQGAAAAAGSGAGTGGGTASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKA

SEQ ID NO: 6442 - protein, 221 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNK

SEQ ID NO: 6443 - protein, 210 aa, Homo sapiens
  MOD_RES (1)..(1): Any amino acid
XKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGDQQSGYGKVSRRGGHQNSYKPY

SEQ ID NO: 6444 - protein, 201 aa, Homo sapiens
MDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 6445 - protein, 303 aa, Homo sapiens
MSEEQFGGDGAAAAATAAASGGTEGGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 6446 - protein, 657 aa, Homo sapiens
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETVSGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRPWIKDRFMAPDIEAAHRLLLEQKVWEVAAPYIEKYRMEHIPESRPLSPTAFSLQFLHKKSTKIPESEDL

SEQ ID NO: 6447 - protein, 591 aa, Homo sapiens
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETVSGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRFGK

SEQ ID NO: 6448 - protein, 449 aa, Homo sapiens
MLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETVSGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRPWIKDRFMAPDIEAAHRLLLEQKVWEVAAPYIEKYRMEHIPESRPLSPTAFSLQFLHKKSTKIPESEDL

SEQ ID NO: 6449 - protein, 419 aa, Homo sapiens
MAGFGAMEKFLVEYKSAVEKKLAEYKCNTNTAIELKLVRFPEDLENDIRTFFPEYTHQLFGDDETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 6450 - protein, 334 aa, Homo sapiens
MFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQLLETVHRYYTEFPTVLDITAEDPSKSYVKLRDFVLVKLCQDLPCFSREKLMQGFNEDMAIEAQQKFKINKQHARRVYEILRLLVTDMSDAEQYRSYRLDIKRRLISPYKKKQRDLAKMRKCLRPEELTNQMNQIEISMQHEQLEESFQELVEDYRRVIERLAQE

SEQ ID NO: 6451 - protein, 289 aa, Homo sapiens
MTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPGVQMQAIPEDAIPEESGDEDEDDPDKRISICSSDKRIACEEEFSDSEEEGEGGRKNSSNFKKAKRVKTEDEKEKDPEEKKEVTEEEKTKEEKPEAKGVKEEVKLA

SEQ ID NO: 6452 - protein, 482 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPGVQMQAIPEDAIPEESGDEDEDDPDKRISICSSDKRIACEEEFSDSEEEGEGGRKNSSNFKKAKRVKTEDEKEKDPEEKKEVTEEEKTKEEKPEAKGVKEEVKLA

SEQ ID NO: 6453 - protein, 211 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRSSAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDES

SEQ ID NO: 6454 - protein, 347 aa, Homo sapiens
MLHTTQLYQHVPETRWPIVYSPRYNITFMGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 6455 - protein, 236 aa, Homo sapiens
MGLEKLHPFDAGKWGKVINFLKEEKLLSDSMLVEAREASEEDLLVVHTRRYLNELKWSFAVATITEIPPVIFLPNFLVQRKVLRPLRTQTGGTIMGVASTTAPATVAGASVPMRTSRSPSSFCLSVWRASPGLPSLILMPIRAMGMSETSWTTSVCTSWMSTTATSTQGTALPSRPSGGRWSWSGAQRMMSTWIRWRGTSRNPSRSTCPTWWYTMQAPTSSRGTALGGCPSAQRAS

SEQ ID NO: 6456 - protein, 319 aa, Homo sapiens
MGLEKLHPFDAGKWGKVINFLKEEKLLSDSMLVEAREASEEDLLVVHTRRYLNELKWSFAVATITEIPPVIFLPNFLVQRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 6457 - protein, 155 aa, Homo sapiens [sequence omitted]

SEQ ID NO: 6458 - protein, 296 aa, Homo sapiens
MGLEKLHPFDAGKWGKVINFLKEEKLLSDSMLVEAREASEEDLLVVHTRRYLNELKRKVLRPLRTQTGGTIMAGKLAVERGWAINVGGGFHHCSSDRGGGFCAYADITLAIKFLFERVEGISRATIIDLDAHQGNGHERDFMDDKRVYIMDVYNRHIYPGDRFAKQAIRRKVELEWGTEDDEYLDKVERNIKKSLQEHLPDVVVYNAGTDILEGDRLGGLSISPAGIVKRDELVFRMVRGRRVPILMVTSGGYQKRTARIIADSILNLFGLGLIGPESPSVSAQNSDTPLLPPAVP

SEQ ID NO: 6459 - protein, 458 aa, Homo sapiens
MKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 6460 - protein, 582 aa, Homo sapiens
MRSPPCGLLRWFGGPLLASWCRCHLRFRAFGTSAGWYRAFPAPPPLLPPACPSPRDYRPHVSLSPFLSRPSRGGSSSSSSSRRRSPVAAVAGEPMAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 6461 - protein, 488 aa, Homo sapiens
MAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 6462 - protein, 458 aa, Homo sapiens; identical to SEQ ID NO: 6459

SEQ ID NO: 6463 - protein, 428 aa, Homo sapiens
MAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 6464 - protein, 1084 aa, Homo sapiens
MSSQSHPDGLSGRDQPVELLNPARVNHMPSTVDVATALPLQVAPSAVPMDLRLDHQFSLPVAEPALREQQLQQELLALKQKQQIQRQILIAEFQRQHEQLSRQHEAQLHEHIKQQQEMLAMKHQQELLEHQRKLERHRQEQELEKQHREQKLQQLKNKEKGKESAVASTEVKMKLQEFVLNKKKALAHRNLNHCISSDPRYWYGKTQHSSLDQSSPPQSGVSTSYNHPVLGMYDAKDDFPLRKTASEPNLKLRSRLKQKVAERRSSPLLRRKDGPVVTALKKRPLDVTDSACSSAPGSGPSSPNNSSGSVSAENGIAPAVPSIPAETSLAHRLVAREGSAAPLPLYTSPSLPNITLGLPATGPSAGTAGQQDAERLTLPALQQRLSLFPGTHLTPYLSTSPLERDGGAAHSPLLQHMVLLEQPPAQAPLVTGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVDSDTIWNEVHSAGAARLAVGCVVELVFKVATGELKNGFAVVRPPGHHAEESTPMGFCYFNSVAVAAKLLQQRLSVSKILIVDWDVHHGNGTQQAFYSDPSVLYMSLHRYDDGNFFPGSGAPDEVGTGPGVGFNVNMAFTGGLDPPMGDAEYLAAFRTVVMPIASEFAPDVVLVSSGFDAVEGHPTPLGGYNLSARCFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 6465 - protein, 646 aa, Homo sapiens
MLAMKHQQELLEHQRKLERHRQEQELEKQHREQKLQQLKNKEKGKESAVASTEVKMKLQEFVLNKKKALAHRNLNHCISSDPRYWYGKTQHSSLDQSSPPQSGVSTSYNHPVLGMYDAKDDFPLRKTASEPNLKLRSRLKQKVAERRSSPLLRRKDGPVVTALKKRPLDVTDSACSSAPGSGPSSPNNSSGSVSAENGIAPAVPSIPAETSLAHRLVAREGSAAPLPLYTSPSLPNITLGLPATGPSAGTAGQQDAERLTLPALQQRLSLFPGTHLTPYLSTSPLERDGGAAHSPLLQHMVLLEQPPAQAPLVTGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVSVPLMCK

SEQ ID NO: 6466 - protein, 972 aa, Homo sapiens
MLAMKHQQELLEHQRKLERHRQEQELEKQHREQKLQQLKNKEKGKESAVASTEVKMKLQEFVLNKKKALAHRNLNHCISSDPRYWYGKTQHSSLDQSSPPQSGVSTSYNHPVLGMYDAKDDFPLRKTASEPNLKLRSRLKQKVAERRSSPLLRRKDGPVVTALKKRPLDVTDSACSSAPGSGPSSPNNSSGSVSAENGIAPAVPSIPAETSLAHRLVAREGSAAPLPLYTSPSLPNITLGLPATGPSAGTAGQQDAERLTLPALQQRLSLFPGTHLTPYLSTSPLERDGGAAHSPLLQHMVLLEQPPAQAPLVTDWYLSGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVDSDTIWNEVHSAGAARLAVGCVVELVFKVATGELKNGFAVVRPPGHHAEESTPMGFCYFNSVAVAAKLLQQRLSVSKILIVDWDVHHGNGTQQAFYSDPSVLYMSLHRYDDGNFFPGSGAPDEVGTGPGVGFNVNMAFTGGLDPPMGDAEYLAAFRTVVMPIASEFAPDVVLVSSGFDAVEGHPTPLGGYNLSARCFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 6467 - protein, 737 aa, Homo sapiens
MDVATALPLQVAPSAVPMDLRLDHQFSLPVAEPALREQQLQQELLALKQKQQIQRQILIAEFQRQHEQLSRQHEAQLHEHIKQQQEMLAMKHQQELLEHQRKLERHRQEQELEKQHREQKLQQLKNKEKGKESAVASTEVKMKLQEFVLNKKKALAHRNLNHCISSDPRYWYGKTQHSSLDQSSPPQSGVSTSYNHPVLGMYDAKDDFPLRKTASEPNLKLRSRLKQKVAERRSSPLLRRKDGPVVTALKKRPLDVTDSACSSAPGSGPSSPNNSSGSVSAENGIAPAVPSIPAETSLAHRLVAREGSAAPLPLYTSPSLPNITLGLPATGPSAGTAGQQDAERLTLPALQQRLSLFPGTHLTPYLSTSPLERDGGAAHSPLLQHMVLLEQPPAQAPLVTDWYLSGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVSVPLMCK

SEQ ID NO: 6468 - protein, 668 aa, Homo sapiens
MVLLEQPPAQAPLVTGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVDSDTIWNEVHSAGAARLAVGCVVELVFKVATGELKNGFAVVRPPGHHAEESTPMGFCYFNSVAVAAKLLQQRLSVSKILIVDWDVHHGNGTQQAFYSDPSVLYMSLHRYDDGNFFPGSGAPDEVGTGPGVGFNVNMAFTGGLDPPMGDAEYLAAFRTVVMPIASEFAPDVVLVSSGFDAVEGHPTPLGGYNLSARCFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 6469 - protein, 29 aa, Homo sapiens
MSSQSHPDGLSGRDQPVELLNPARVNHMP

SEQ ID NO: 6470 - protein, 1215 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 6471 - protein, 210 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAII

SEQ ID NO: 6472 - protein, 1215 aa, Homo sapiens; identical to SEQ ID NO: 6470

SEQ ID NO: 6473 - protein, 210 aa, Homo sapiens; identical to SEQ ID NO: 6471

SEQ ID NO: 6474 - protein, 296 aa, Homo sapiens [sequence omitted]

SEQ ID NO: 6475 - protein, 142 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELM

SEQ ID NO: 6476 - protein, 269 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPR

SEQ ID NO: 6477 - protein, 817 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTLPIACLRGTTTPAQKERGAAQWPQEGADIMRITLAGGELTGRHGKVAYVIKYKL

SEQ ID NO: 6478 - protein, 51 aa, Homo sapiens
MTSTGQDSTTTRQRRSRQNPQSPPQDSSVTSKRNIKKGAVPRSIPNLAEVK

SEQ ID NO: 6479 - protein, 171 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTY

SEQ ID NO: 6480 - protein, 161 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNE

SEQ ID NO: 6481 - protein, 167 aa, Homo sapiens
MTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVL

SEQ ID NO: 6482 - protein, 1229 aa, Homo sapiens
MSGANRGRGQASSTMTSTGQDSTTTRQRRSRQNPQSPPQDSSVTSKRNIKKGAVPRSIPNLAEVKKKGKMKKLGQAMEEDLIVGLQGMDLNLEAEALAGTGLVLDEQLNEFHCLWDDSFPEGPERLHAIKEQLIQEGLLDRCVSFQARFAEKEELMLVHSLEYIDLMETTQYMNEGELRVLADTYDSVYLHPNSYSCACLASGSVLRLVDAVLGAEIRNGMAIIRPPGHHAQHSLMDGYCMFNHVAVAARYAQQKHRIRRVLIVDWDVHHGQGTQFTFDQDPSVLYFSIHRYEQGRFWPHLKASNWSTTGFGQGQGYTINVPWNQVGMRDADYIAAFLHVLLPVALEFQPQLVLVAAGFDALQGDPKGEMAATPAGFAQLTHLLMGLAGGKLILSLEGGYNLRALAEGVSASLHTLLGDPCPMLESPGAPCRSAQASVSCALEALEPFWEVLVRSTETVERDNMEEDNVEESEEEGPWEPPVLPILTWPVLQSRTGLVYDQNMMNHCNLWDSHHPEVPQRILRIMCRLEELGLAGRCLTLTPRPATEAELLTCHSAEYVGHLRATEKMKTRELHRESSNFDSIYICPSTFACAQLATGAACRLVEAVLSGEVLNGAAVVRPPGHHAEQDAACGFCFFNSVAVAARHAQTISGHALRILIVDWDVHHGNGTQHMFEDDPSVLYVSLHRYDHGTFFPMGDEGASSQIGRAAGTGFTVNVAWNGPRMGDADYLAAWHRLVLPIAYEFNPELVLVSAGFDAARGDPLGGCQVSPEGYAHLTHLLMGLASGRIILILEGGYNLTSISESMAACTRSLLGDPPPLLTLPRPPLSGALASITETIQVHRRYWRSLRVMKVEDREGPSSSKLVTKKAPQPAKPRLAERMTTREKKVLEAGMGKVTSASFGEESTPGQTNSETAVVALTQDQPSEAATGGATLAQTISEAAIGGAMLGQTTSEEAVGGATPDQTTSEETVGGAILDQTTSEDAVGGATLGQTTSEEAVGGATLAQTTSEAAMEGATLDQTTSEEAPGGTELIQTPLASSTDHQTPPTSPVQGTTPQISPSTLIGSLRTLELGSESQGASESQAPGEENLLGEAAGGQDMADSMLMQGSRGLTDQAIFYAVTPLPWCPHLVAVCPIPAAGLDVTQPCGDCGTIQENWVCLSCYQVYCGRYINGHMLQHHGNSGHPLVLSYIDLSAWCYYCQAYVHHQALLDVKNIAHQNKFGEDMPHPH

SEQ ID NO: 6483 - protein, 991 aa, Homo sapiens
MHSPGADGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 6484 - protein, 954 aa, Homo sapiens
MHSPGADGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 6485 - protein, 1014 aa, Homo sapiens
MSDLRKRELGALFTSRGTGGVEWDGTQVSPGAHYCSPTGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHMGALTLSQIPGHGSSQQQAGGAFSWPGHPCRAAVVMVNTGAACSAWPPVQTPGCLECQGLTKKKWRQ

SEQ ID NO: 6486 - protein, 133 aa, Homo sapiens
MHSPGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPG

SEQ ID NO: 6487 - protein, 952 aa, Homo sapiens
MDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 6488 - protein, 974 aa, Homo sapiens
MHSPGAGCPRPCADTPGPQPQPMDLRVGQRPPVEPPPEPTLLALQRPQRLHHHLFLAGLQQQRSVEPMRLSMDTPMPELQVGPQEQELRQLLHKDKSKRSAVASSVVKQKLAEVILKKQQAALERTVHPNSPGIPYRTLEPLETEGATRSMLSSFLPPVPSLPSDPPEHFPLRKTVSEPNLKLRYKPKKSLERRKNPLLRKESAPPSLRRRPAETLGDSSPSSSSTPASGCSSPNDSEHGPNPILGSEALLGQRLRLQETSVAPFALPTVSLLPAITLGLPAPARADSDRRTHPTLGPRGPILGSPHTPLFLPHGLEPEAGGTLPSRLQPILLLDPSGSHAPLLTVPGLGPLPFHFAQSLMTTERLSGSGLHWPLSRTRSEPLPPSATAPPPPGPMQPRLEQLKTHVQVIKRSAKPSEKPRLRQIPSAEDLETDGGGPGQVVDDGLEHRELGHGQPEARGPAPLQQHPQVLLWEQQRLAGRLPRGSTGDTVLLPLAQGGHRPLSRAQSSPAAPASLSAPEPASQARVLSSSETPARTLPFTTGLIYDSVMLKHQCSCGDNSRHPEHAGRIQSIWSRLQERGLRSQCECLRGRKASLEELQSVHSERHVLLYGTNPLSRLKLDNGKLAGLLAQRMFVMLPCGGVGVDTDTIWNELHSSNAARWAAGSVTDLAFKVASRELKNGFAVVRPPGHHADHSTAMGFCFFNSVAIACRQLQQQSKASKILIVDWDVHHGNGTQQTFYQDPSVLYISLHRHDDGNFFPGSGAVDEVGAGSGEGFNVNVAWAGGLDPPMGDPEYLAAFRIVVMPIAREFSPDLVLVSAGFDAAEGHPAPLGGYHVSAKCFGYMTQQLMNLAGGAVVLALEGGHDLTAICDASEACVAALLGNRVDPLSEEGWKQKPNLNAIRSLEAVIRVHSKYWGCMQRLASCPDSWVPRVPGADKEEVEAVTALASLSVGILAEDRPSEQLVEEEEPMNL

SEQ ID NO: 6489 - protein, 272 aa, Homo sapiens
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGKSDVSDVGLGKGRYYSVNVPIQDGIQDEKYYQICESVRTSCPKSRPVEAAAAACLPHLHSLV

SEQ ID NO: 6490 - protein, 377 aa, Homo sapiens
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 6491 - protein, 286 aa, Homo sapiens
MEEPEEPADSGQSLVPVYIYSPEYVSMCDSLAKIPKRASMVHSLIEAYALHKQMRDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 6492 - protein, 182 aa, Homo sapiens
MTVSLHKFSPGFFPGTGDVSDVGLGKGRYYSVNVPIQDGIQDEKYYQICESVLKEVYQAFNPKAVVLQLGADTIAGDPMCSFNMTPVGIGKCLKYILQWQLATLILGGGGYNLANTARCWTYLTGVILGKTLSSEIPDHEFFTAYGPDYVLEITPSCRPDRNEPHRIQQILNYIKGNLKHVV

SEQ ID NO: 6493 - protein, 146 aa, Homo sapiens
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKK

SEQ ID NO: 6494 - protein, 158 aa, Homo sapiens
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKETCVYVALYKAF

SEQ ID NO: 6495 - protein, 139 aa, Homo sapiens
MEEPEEPADSGQSLVPVYIYSPEYVSMCDSLAKIPKRASMVHSLIEAYALHKQMRDEASGFCYLNDAVLGILRLRRKFERILYVDLDLHHGDGTGDVSDVGLGKGRYYSVNVPIQDGIQDEKYYQICERYEPPAPNPGL

SEQ ID NO: 6496 - protein, 256 aa, Homo sapiens
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLGYDCPATEGIFDYAAAIGGATITAAQCLIDGMCKVAINWSGGWHHAKKDEASGFCYLNDAVLGILRLRRKFERILYVDLDLHHGDGVEDAFSFTSKVMTVSLHKFSPGFFPGTGDVSDVGLGKGRYYSVNVPIQDGIQDEKYYQICERYEPPAPNPGL

SEQ ID NO: 6497 - protein, 276 aa, Homo sapiens
MAGPAALSAAAAAALAAALLLLRREDPGPGAGPSMAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 6498 - protein, 242 aa, Homo sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 6499 - protein, 242 aa, Homo sapiens; identical to SEQ ID NO: 6498

SEQ ID NO: 6500 - protein, 242 aa, Homo sapiens; identical to SEQ ID NO: 6498

SEQ ID NO: 6501 - protein, 133 aa, Homo sapiens
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAVRKAYALFPFCWPVISRILFLLTLFLCACCNA

SEQ ID NO: 6502 - protein, 133 aa, Homo sapiens; identical to SEQ ID NO: 6501

SEQ ID NO: 6503 - protein, 133 aa, Homo sapiens; identical to SEQ ID NO: 6501

SEQ ID NO: 6504 - protein, 557 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMYAHKQEPPQYSHTSRFPSAMVVTDTSSISTLTNMSSSKQCPLQAW

SEQ ID NO: 6505 - protein, 457 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQMSSTSLVMPTHHLLRAQQQGPCFPHHHPLGSCHGKAQ

SEQ ID NO: 6506 - protein, 445 aa, Homo sapiens [sequence omitted]

SEQ ID NO: 6507 - protein, 425 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFNQTVQSSGNMTDKSSQDQLLFLFPEFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMDLSLRRRFAPSQHLDEYPQPLPP

SEQ ID NO: 6508 - protein, 531 aa, Homo sapiens
MVSKLTSLQQELLSALLSSGVTKEVLVQALEELLPSPNFGVKLETLPLSPGSGAEPDTKPVFHTLTNGHAKGRLSGDEGSEDGDDYDTPPILKELQALNTEEAAEQRAEVDRMLSEDPWRAAKMIKGYMQQHNIPQREVVDVTGLNQSHLSQHLNKGTPMKTQKRAALYTWYVRKQREILRQFSQQSHGPGQSDDACSEPTNKKMRRNRFKWGPASQQILYQAYDRQKNPSKEEREALVEECNRAECLQRGVSPSKAHGLGSNLVTEVRVYNWFANRRKEEAFRQKLAMDAYSSNQTHSLNPLLSHGSPHHQPSSSPPNKLSGVRYSQQGNNEITSSSTISHHGNSAMVTSQSVLQQVSPASLDPGHNLLSPDGKMISVSGGGLPPVSTLTNIHSLSHHNPQQSQNLIMTPLSGVMAIAQSLNTSQAQSVPVINSVAGSLAALQPVQFSQQLHSPHQQPLMQQSPGSHMAQQPFMAAVTQLQNSHMYAHKQEPPQYSHTSRFPSAMVVTDTSSISTLTNMSSSKQCPLQAW

SEQ ID NO: 6509 - protein, 280 aa, Homo sapiens
MKFRAKIVDGACLNHFTRISNMIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDVSIYLPVLKTMKSVVEKMKNISNHLVIEANLDGELNLKIETELVCVTTHFKDLGNPPLASESTHEDRNVEHMAEVHIDIRKLLQFLAGQQVNPTKALCNIVNNKMVHFDLLHEDVSLQYFIPALS

SEQ ID NO: 6510 - protein, 259 aa, Homo sapiens
MIAKLAKTCTLRISPDKLNFILCDKLANGGVSMWCELEQENFFNEFQMEGVSAENNEIYLELTSENLSRALKTAQNARALKIKLTNKHFPCLTVSVELLSMSSSSRIVTHDIPIKVIPRKLWKDLQEPVVPDPDVSIYLPVLKTMKSVVEKMKNISNHLVIEANLDGELNLKIETELVCVTTHFKDLGNPPLASESTHEDRNVEHMAEVHIDIRKLLQFLAGQQVNPTKALCNIVNNKMVHFDLLHEDVSLQYFIPALS

SEQ ID NO: 6511 - protein, 280 aa, Homo sapiens; identical to SEQ ID NO: 6509

SEQ ID NO: 6512 - protein, 259 aa, Homo sapiens; identical to SEQ ID NO: 6510

SEQ ID NO: 6513 - protein, 709 aa, Homo sapiens
MSFPKAPLKRFNDPSGCAPSPGAYDVKTLEVLKGPVSFQKSQRFKQQKESKQNLNVDKDTTLPASARKVKSSESKIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 6514 - protein, 724 aa, Homo sapiens
MSFPKAPLKRFNDPSGCAPSPGAYDVKTLEVLKGPVSFQKSQRFKQQKESKQNLNVDKDTTLPASARKVKSSESKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 6515 - protein, 725 aa, Homo sapiens
MSFPKAPLKRFNDPSGCAPSPGAYDVKTLEVLKGPVSFQKSQRFKQQKESKQNLNVDKDTTLPASARKVKSSESKKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 6516 - protein, 701 aa, Homo sapiens
MSFPKAPLKRFNDPSGCAPSPGAYDVKTLEVLKGPVSFQKSQRFKQQKESKQNLNVDKDTTLPASARKVKSSESKKESQKNDKDLKILEKEIRVLLQERGAQDRRIQDLETELEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 6517 - protein, 638 aa, Homo sapiens
MTLLIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 6518 - protein, 331 aa, Homo sapiens
MSFPKAPLKRFNDPSGCAPSPGAYDVKTLEVLKGPVSFQKSQRFKQQKESKQNLNVDKDTTLPASARKVKSSESKIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKKKQMRRKK

SEQ ID NO: 6519 - protein, 178 aa, Homo sapiens
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAGLMPVAQQPVYCASKHGIVGFTRSAAPTIDCQWIDNTH

SEQ ID NO: 6520 - protein, 266 aa, Homo sapiens [sequence omitted]

SEQ ID NO: 6521 - protein, 145 aa, Homo sapiens
MSKQNGGEGGIIINMSSLAGLMPVAQQPVYCASKHGIVGFTRSAALAANLMNSGVRLNAICPGFVNTAILESIEKEENMGQYIEYKDHIKDMIKYYGILDPPLIANGLITLIEDDALNGAIMKITTSKGIHFQDYDTTPFQAKTQ

SEQ ID NO: 6522 - protein, 145 aa, Homo sapiens; identical to SEQ ID NO: 6521

SEQ ID NO: 6523 - protein, 143 aa, Homo sapiens
MHVNGKVALVTGAAQGIGRAFAEALLLKGAKVALVDWNLEAGVQCKAALDEQFEPQKTLFIQCDVADQQQLRDTFRKVVDHFGRLDILVNNAGVNNEKNWEKTLQINLVSVISGTYLGLDYMSKQNGGEGGIIINMSSLAAHH

SEQ ID NO: 6524 - protein, 733 aa, Homo sapiens
MTFPEADILLKSGECAGQTMLDTMEAPGHSRQLLLQLNNQRTKGFLCDVIIVVQNALFRAHKNVLAASSAYLKSLVVHDNLLNLDHDMVSPAVFRLVLDFIYTGRLADGAEAAAAAAVAPGAEPSLGAVLAAASYLQIPDLVALCKKRLKRHGKYCHLRGGGGGGGGYAPYGRPGRGLRAATPVIQACYPSPVGPPPPPAAEPPSGPEAAVNTHCAELYASGPGPAAALCASERRCSPLCGLDLSKKSPPGSAAPERPLAERELPPRPDSPPSAGPAAYKEPPLALPSLPPLPFQKLEEAAPPSDPFRGGSGSPGPEPPGRPDGPSLLYRWMKHEPGLGSYGDELGRERGSPSERCEERGGDAAVSPGGPPLGLAPPPRYPGSLDGPGAGGDGDDYKSSSEETGSSEDPSPPGGHLEGYPCPHLAYGEPESFGDNLYVCIPCGKGFPSSEQLNAHVEAHVEEEEALYGRAEAAEVAAGAAGLGPPFGGGGDKVAGAPGGLGELLRPYRCASCDKSYKDPATLRQHEKTHWLTRPYPCTICGKKFTQRGTMTRHMRSHLGLKPFACDACGMRFTRQYRLTEHMRIHSGEKPYECQVCGGKFAQQRNLISHMKMHAVGGAAGAAGALAGLGGLPGVPGPDGKGKLDFPEGVFAVARLTAEQLSLKQQDKAAAAELLAQTTHFLHDPKVALESLYPLAKFTAELGLSPDKAAEVLSQGAHLAAGPDGRTIDRFSPT

SEQ ID NO: 6525 - protein, 714 aa, Homo sapiens
MLDTMEAPGHSRQLLLQLNNQRTKGFLCDVIIVVQNALFRAHKNVLAASSAYLKSLVVHDNLLNLDHDMVSPAVFRLVLDFIYTGRLADGAEAAAAAAVAPGAEPSLGAVLAAASYLQIPDLVALCKKRLKRHGKYCHLRGGGGGGGGYAPYGRPGRGLRAATPVIQACYPSPVGPPPPPAAEPPSGPEAAVNTHCAELYASGPGPAAALCASERRCSPLCGLDLSKKSPPGSAAPERPLAERELPPRPDSPPSAGPAAYKEPPLALPSLPPLPFQKLEEAAPPSDPFRGGSGSPGPEPPGRPDGPSLLYRWMKHEPGLGSYGDELGRERGSPSERCEERGGDAAVSPGGPPLGLAPPPRYPGSLDGPGAGGDGDDYKSSSEETGSSEDPSPPGGHLEGYPCPHLAYGEPESFGDNLYVCIPCGKGFPSSEQLNAHVEAHVEEEEALYGRAEAAEVAAGAAGLGPPFGGGGDKVAGAPGGLGELLRPYRCASCDKSYKDPATLRQHEKTHWLTRPYPCTICGKKFTQRGTMTRHMRSHLGLKPFACDACGMRFTRQYRLTEHMRIHSGEKPYECQVCGGKFAQQRNLISHMKMHAVGGAAGAAGALAGLGGLPGVPGPDGKGKLDFPEGVFAVARLTAEQLSLKQQDKAAAAELLAQTTHFLHDPKVALESLYPLAKFTAELGLSPDKAAEVLSQGAHLAAGPDGRTIDRFSPT

SEQ ID NO: 6526 - protein, 735 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGII

SEQ ID NO: 6527 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 6528 - protein, 767 aa, Homo sapiens [sequence omitted]

SEQ ID NO: 6529 - protein, 827 aa, Homo sapiens
MEGAGGANDKKNRISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 6530 - protein, 850 aa, Homo sapiens
MSSQCRSLENKFVFLKEGLGNSKPEELEEIRIENGRISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 6531 - protein, 577 aa, Homo sapiens
MKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 6532 - protein, 767 aa, Homo sapiens [sequence omitted]

SEQ ID NO: 6533 - protein, 431 aa, Homo sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6534 - protein, 414 aa, Homo sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6535 - protein, 470 aa, Homo sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6536 - protein, 470 aa, Homo sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6537 - protein, 366 aa, Homo sapiens
MEDIQTNAELKSTQEQSVPAESAAVLNDYSLTKSHEMENVDSGEGPANEDEDIGVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6538 - protein, 375 aa, Homo sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6539 - protein, 288 aa, Homo sapiens
MEDIQTNAELKSTQEQSVPAESAAVLNDYSLTKSHEMENVDSGEGPANEDEDIGGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6540 - protein, 422 aa, Homo sapiens
MEDIQTNAELKSTQEQSVPAESAAVLNDYSLTKSHEMENVDSGEGPANEDEDIGGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6541 - protein, 327 aa, Homo sapiens
MEDIQTNAELKSTQEQSVPAESAAVLNDYSLTKSHEMENVDSGEGPANEDEDIGASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6542 - protein, 463 aa, Homo sapiens
  MOD_RES (1)..(1): Any amino acid
XQEQSVPADDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6543 - protein, 424 aa, Homo sapiens
  MOD_RES (1)..(1): Any amino acid
XQEQSVPADDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6544 - protein, 453 aa, Homo sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6545 - protein, 509 aa, Homo sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6546 - protein, 475 aa, Homo sapiens
MEDIQTNAELKSTQEQSVPADDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 6547 - protein, 149 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEVRSRSDH

SEQ ID NO: 6548 - protein, 155 aa, Homo sapiens
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCR

SEQ ID NO: 6549 - protein, 245 aa, Homo sapiens
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 6550 - protein, 279 aa, Homo sapiens
MLSPANGEQLHLVNYVEDYLDSIESLPFDLQRNVSLMREIDAKYQEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 6551 - protein, 235 aa, Homo sapiens
MEILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 6552 - protein, 422 aa, Homo sapiens
MSFVECPYHSPAERLVAEADEGGPSAITGMGLCFRCLLFSFSGRSGVEGGRVDLNVFGSLGLQPWIGSSRCWGGPCSSALRCGWFSSWPPPSKSAIPIGGGSRGAGRVSRWPPPHWLEAWRVSPLPLSPLSPATFGRGFIAVAVIPGLWARGRGCSSDRLPRPAGPARRQFQAASLLTRGWGRAWPWKQILKELDECYERFSRETDGAQKRRMLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 6553 - protein, 210 aa, Homo sapiens
MLHCVQRALIRSQELGDEKIQIVSQMVELVENRTRQVDSHVELFEAQQELGDTAGNSGKAGADRPKGEAAAQADKPNSKRSRRQRNNENRENASSNHDHDDGASGTPKEKKAKTSKKKKRSKAKAEREASPADLPIDPNEPTYCLCNQVSYGEMIGCDNDECPIEWFHFSCVGLNHKPKGKWYCPKCRGENEKTMDKALEKSKKERAYNR

SEQ ID NO: 6554 - protein, 248 aa, Homo sapiens
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKSRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 6555 - protein, 249 aa, Homo sapiens
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 6556 - protein, 246 aa, Homo sapiens
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKEGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 6557 - protein, 179 aa, Homo sapiens
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTVPLSGSILPVWG

SEQ ID NO: 6558 - protein, 225 aa, Homo sapiens
MAAGMYLEHYLDNLKAEIDKLATEYMSSARSLSSEEKLALLKQIQEAYGKCKEFGDDKVQLAMQTYEMVDKHIRRLDTDLARFEADLKEKQIESSDYDSSSSKGKKKGRTQKEKKAARARSKGKNSDEEAPKTAQKKLKLVRTSPEYGMPSVTFGSVHPSDVLDMPVDPNEPTYCLCHQVSYGEMIGCDNPDCSIEWFHFACVGLTTKPRGKWFCPRCSQERKKK

SEQ ID NO: 6559 - protein, 1242 aa, Homo sapiens
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLRRHHLNNPPPSQVGLTRRSRTESITATSPASMVGGKPGSFRVRASSDGEGTMSRPASVDGSPVSPSTNRTHAHRHRGSARLHPPLNHSRSIPMPASRCSPSATSPVSLSSSSTSGHGSTSDCLFPRRSSASVSGSPSDGGFISSDEYGSSPCDFRSSFRSVTPDSLGHTPPARGEEELSNYICMGGKGPSTLTAPNGHYILSRGGNGHRCTPGTGLGTSPALAGDEAASAADLDNRFRKRTHSAGTSPTITHQKTPSQSSVASIEEYTEMMPAYPPGGGSGGRLPGHRHSAFVPTRSYPEEGLEMHPLERRGGHHRPDSSTLHTDDGYMPMSPGVAPVPSGRKGSGDYMPMSPKSVSAPQQIINPIRRHPQRVDPNGYMMMSPSGGCSPDIGGGPSSSSSSSNAVPSGTSYGKLWTNGVGGHHSHVLPHPKPPVESSGGKLLPCTGDYMNMSPVGDSNTSSPSDCYYGPEDPQHKPVLSYYSLPRSFKHTQRPGEPEEGARHQHLRLSTSSGRLLYAATADDSSSSTSSDSLGGGYCGARLEPSLPHPHHQVLQPHLPRKVDTAAQTNSRLARPTRLSLGDPKASTLPRAREQQQQQQPLLHPPEPKSPGEYVNIEFGSDQSGYLSGPVAFHSSPSVRCPSQLQPAPREEETGTEEYMKMDLGPGRRAAWQESTGVEMGRLGPAPPGAASICRPTRAVPSSRGDYMTMQMSCPRQSYVDTSPAAPVSYADMRTGIAAEEVSLPRATMAAASSSSAASASPTGPQGAAELAAHSSLLGGPQGPGGMSAFTRVNLSPNRNQSAKVIRADPQGCRRRHSSETFSSTPSATRVGNTVPFGAGAAVGGGGGSSSSSEDVKRHSSASFENVWLRPGELGGAPKEPAKLCGAAGGLENGLNYIDLDLVKDFKQCPQECTPEPQPPPPPPPHQPLGSGESSSTRRSSEDLSAYASISFQKQPEDRQ

SEQ ID NO: 6560 - protein, 195 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGWPKTHPGGEQKEGTEASLQIRGKKKEQRREIGSRNAECRGKKGK

SEQ ID NO: 6561 - protein, 153 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 6562 - protein, 158 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGSTFEERK

SEQ ID NO: 6563 - protein, 139 aa, Homo sapiens
LKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGSTFEERK

SEQ ID NO: 6564 - protein, 137 aa, Homo sapiens
MITPTVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKEVHLKNASRGSAGNKNYRM

SEQ ID NO: 6565 - protein, 158 aa, Homo sapiens; identical to SEQ ID NO: 6562

SEQ ID NO: 6566 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 6567 - protein, 180 aa, Homo sapiens
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 6568 - protein, 180 aa, Homo sapiens; identical to SEQ ID NO: 6567

SEQ ID NO: 6569 - protein, 183 aa, Homo sapiens
MGIPMGKSMLVLLTFLAFASCCIAAYRPSETLCGGELVDTLQFVCGDRGFYFRLPGRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 6570 - protein, 183 aa, Homo sapiens; identical to SEQ ID NO: 6569

SEQ ID NO: 6571 - protein, 180 aa, Homo sapiens; identical to SEQ ID NO: 6567

SEQ ID NO: 6572 - protein, 183 aa, Homo sapiens; identical to SEQ ID NO: 6569

SEQ ID NO: 6573 - protein, 180 aa, Homo sapiens; identical to SEQ ID NO: 6567

SEQ ID NO: 6574 - protein, 183 aa, Homo sapiens; identical to SEQ ID NO: 6569

SEQ ID NO: 6575 - protein, 180 aa, Homo sapiens; identical to SEQ ID NO: 6567

SEQ ID NO: 6576 - protein, 180 aa, Homo sapiens; identical to SEQ ID NO: 6567

SEQ ID NO: 6577 - protein, 236 aa, Homo sapiens
MVSPDPQIIVVAPETELASMQVQRTEDGVTIIQIFWVGRKGELLRRTPVSSAMQTPMGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 6578 - protein, 291 aa, Homo sapiens
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6579 - protein, 297 aa, Homo sapiens
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGEPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6580 - protein, 194 aa, Homo sapiens
MQRARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6581 - protein, 153 aa, Homo sapiens
  MOD_RES (1)..(1): Any amino acid
XSEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6582 - protein, 143 aa, Homo sapiens
  MOD_RES (1)..(1): Any amino acid
XESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6583 - protein, 263 aa, Homo sapiens
MQRARPTLWAACEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6584 - protein, 277 aa, Homo sapiens [sequence omitted]

SEQ ID NO: 6585 - protein, 189 aa, Homo sapiens [sequence omitted]

SEQ ID NO: 6586 - protein, 268 aa, Homo sapiens
MQRARPTLWAAALTLLVLLRGPPVARAGASSAGLGPVVRREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6587 - protein, 272 aa, Homo sapiens
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 6588 - protein, 1032 aa, Homo sapiens [sequence omitted]

SEQ ID NO: 6589 - protein, 617 aa, Homo sapiens
MAWEARREPGPRRAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTKK

SEQ ID NO: 6590 - protein, 1049 aa, Homo sapiens
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 6591 - protein, 1130 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 6592 - protein, 1073 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 6593 - protein, 1068 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 6594 - protein, 1112 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 6595 - protein, 1091 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 6596 - protein, 954 aa, Homo sapiens
MGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 6597 - protein, 1130 aa, Homo sapiens; identical to SEQ ID NO: 6591

SEQ ID NO: 6598 - protein, 1086 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 6599 - protein, 1137 aa, Homo sapiens
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 6600 - protein, 1162 aa, Homo sapiens
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKCGFFHRSSQSSSFPTNYHRACLAVQPSAMEVGGPGTVGWDSSNGRSTPRPPCPSTMR

SEQ ID NO: 6601 - protein, 991 aa, Homo sapiens
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKCGFFHRSSQSSSFPTNYHRACLAVQPSAMEVGGPGTVGWDSSNGRSTPRPPCPSTMR

SEQ ID NO: 6602 - protein, 1118 aa, Homo sapiens
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKCGFFHRSSQSSSFPTNYHRACLAVQPSAMEVGGPGTVGWDSSNGRSTPRPPCPSTMR

SEQ ID NO: 6603 - protein, 1122 aa, Homo sapiens
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKCGFFHRSSQSSSFPTNYHRACLAVQPSAMEVGGPGTVGWDSSNGRSTPRPPCPSTMR

SEQ ID NO: 6604 - protein, 1044 aa, Homo sapiens
MAPFATPMVQALTTTRIQRQAEGFQCWRECGTRRSPFEGKETCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 6605 - protein, 1141 aa, Homo sapiens
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 6606 - protein, 1181 aa, Homo sapiens
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 6607 - protein, 1048 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 6608 - protein, 1012 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSRQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 6609 - protein, 1002 aa, Homo sapiens
MLLGTLLLILYILMLCRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 6610 - protein, 482 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVIPIFVQLHHVVH

SEQ ID NO: 6611 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 6612 - protein, 825 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTSLSVAQPGVQWCDISSLQPLTSRFQQFSCLSLPSTWDYRVKILFIRVP

SEQ ID NO: 6613 - protein, 798 aa, Homo sapiens; identical to SEQ ID NO: 6611

SEQ ID NO: 6614 - protein, 49 aa, Homo sapiens
MNLQPIFWIGLISSVCCVFAQTDENRCLKANAKSCGECIQAGPNCGWCT

SEQ ID NO: 6615 - protein, 89 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDI

SEQ ID NO: 6616 - protein, 801 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTQENPIYKSPINNFKNPNYGRKAGL

SEQ ID NO: 6617 - protein, 136 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFK

SEQ ID NO: 6618 - protein, 125 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRS

SEQ ID NO: 6619 - protein, 163 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVK

SEQ ID NO: 6620 - protein, 152 aa, Homo sapiens
MNLQPIFWIGLISSVCCVFAQTDENRCLKANAKSCGECIQAGPNCGWCTNSVSKTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLM

SEQ ID NO: 6621 - protein, 104 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAE

SEQ ID NO: 6622 - protein, 143 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPI

SEQ ID NO: 6623 - protein, 769 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVQLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 6624 - protein, 322 aa, Homo sapiens
GRLGKDLATGVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYE

SEQ ID NO: 6625 - protein, 769 aa, Homo sapiens; identical to SEQ ID NO: 6623

SEQ ID NO: 6626 - protein, 769 aa, Homo sapiens; identical to SEQ ID NO: 6623

SEQ ID NO: 6627 - protein, 769 aa, Homo sapiens; identical to SEQ ID NO: 6623

SEQ ID NO: 6628 - protein, 769 aa, Homo sapiens; identical to SEQ ID NO: 6623

SEQ ID NO: 6629 - protein, 120 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFR

SEQ ID NO: 6630 - protein, 70 aa, Homo sapiens
MLGLRPPLLALVGLLSLGCVLSQECTKFKVSSCRECIESGPGCTWCQKLNFTGPGDPDSIRCDTRPQLLM

SEQ ID NO: 6631 - protein, 49 aa, Homo sapiens
MLGLRPPLLALVGLLSLGCVLSQECTKFKVSSCRECIESGPGCTWCQKL

SEQ ID NO: 6632 - protein, 160 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEI

SEQ ID NO: 6633 - protein, 166 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRI

SEQ ID NO: 6634 - protein, 378 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVQLIKNAYNKLSSRVFLDHNALPDTLKVTYDSFCSNGVTHRNQPRGDCDGVQINVPITFQVKVTATECIQEQSFVIGRWASRT

SEQ ID NO: 6635 - protein, 788 aa, Homo sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 6636 - protein, 751 aa, Homo sapiens
MCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTEILLYYCSFILVHQSLESLRTEFTSKQKDGN

SEQ ID NO: 6637 - protein, 788 aa, Homo sapiens; identical to SEQ ID NO: 6635

SEQ ID NO: 6638 - protein, 452 aa, Homo sapiens
MDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 6639 - protein, 452 aa, Homo sapiens; identical to SEQ ID NO: 6638

SEQ ID NO: 6640 - protein, 452 aa, Homo sapiens; identical to SEQ ID NO: 6638

SEQ ID NO: 6641 - protein, 318 aa, Homo sapiens
MPVDKAKAPLRELLRERAEKMGQNLNRIPYKDTFWKGTTRTRPRNGTLNKHSGIDFKQLNFLTKLNENHSGELWKGRWQGNDIVVKVLKVRDWSTRKSRDFNEECPRLRIFSHPNVLPVLGACQSPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRPKFDMIVPILEKMQDK

SEQ ID NO: 6642 - protein, 325 aa, Homo sapiens
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPDWHIPVEVVPDSTSDLYNFQVSPMPSTSEATTDEDEEGKLPEDIMKLLEQSEWQPTNVDGKGYLLNEPGVQPTSVYGDFSCKEEPEIDSPGGDIGLSLQRVFTDLKNMDATWLDSLLTPVRLPSIQAIPCAP

SEQ ID NO: 6643 - protein, 325 aa, Homo sapiens; identical to SEQ ID NO: 6642

SEQ ID NO: 6644 - protein, 192 aa, Homo sapiens
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTL

SEQ ID NO: 6645 - protein, 451 aa, Homo sapiens
MNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVEPLLARQLYYFAQQNSGHFLRGYDLPEHISNPEDYHRSIRHSSIQE

SEQ ID NO: 6646 - protein, 480 aa, Homo sapiens
LGPTAALSSESRARAAQAGGGPRARARTRGMNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVEPLLARQLYYFAQQNSGHFLRGYDLPEHISNPEDYHRSIRHSSIQE

SEQ ID NO: 6647 - protein, 498 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTEDVKWPPTLQPPTLRPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 6648 - protein, 514 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTDAVQSGPHMTPYSLLKEDVKWPPTLQPPTLRPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 6649 - protein, 498 aa, Homo sapiens; identical to SEQ ID NO: 6647

SEQ ID NO: 6650 - protein, 488 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTEDVKWPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 6651 - protein, 227 aa, Homo sapiens [sequence omitted]

SEQ ID NO: 6652 - protein, 157 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEEMQCSLAPT

SEQ ID NO: 6653 - protein, 106 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDG

SEQ ID NO: 6654 - protein, 59 aa, Homo sapiens
MNQSIPVAPTPPRRVRLKPWLVAQVNSCQYPGLQWVNGEKKLFCIPWRHATRHGPSQDG

SEQ ID NO: 6655 - protein, 498 aa, Homo sapiens; identical to SEQ ID NO: 6647

SEQ ID NO: 6656 - protein, 141 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAG

SEQ ID NO: 6657 - protein, 152 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEEVSV

SEQ ID NO: 6658 - protein, 412 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTVTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 6659 - protein, 189 aa, Homo sapiens
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 6660 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 6661 - protein, 180 aa, Homo sapiens
MALADLYEEGGGGGGEGEDNADSKETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6662 - protein, 159 aa, Homo sapiens
MALETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6663 - protein, 177 aa, Homo sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6664 - protein, 143 aa, Homo sapiens
MQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6665 - protein, 569 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 6666 - protein, 569 aa, Homo sapiens; identical to SEQ ID NO: 6665

SEQ ID NO: 6667 - protein, 182 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLI

SEQ ID NO: 6668 - protein, 114 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFV

SEQ ID NO: 6669 - protein, 106 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLR

SEQ ID NO: 6670 - protein, 80 aa, Homo sapiens
MKVLLRLICFIALLISSLEADKCKEREEKIILVSSANEIDVRPCPLNPNEHKGTITWYKDDSKTPVSTEQASRIHQHKEK

SEQ ID NO: 6671 - protein, 269 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 6672 - protein, 111 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNE

SEQ ID NO: 6673 - protein, 143 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELK

SEQ ID NO: 6674 - protein, 125 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCT

SEQ ID NO: 6675 - protein, 253 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 6676 - protein, 239 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 6677 - protein, 215 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 6678 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 6679 - protein, 162 aa, Homo sapiens; identical to SEQ ID NO: 6678

SEQ ID NO: 6680 - protein, 135 aa, Homo sapiens
MVLGTIDLCSCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 6681 - protein, 135 aa, Homo sapiens; identical to SEQ ID NO: 6680

SEQ ID NO: 6682 - protein, 135 aa, Homo sapiens; identical to SEQ ID NO: 6680

SEQ ID NO: 6683 - protein, 162 aa, Homo sapiens; identical to SEQ ID NO: 6678

SEQ ID NO: 6684 - protein, 193 aa, Homo sapiens
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 6685 - protein, 189 aa, Homo sapiens
MAAEPVEDNCINFVAMKFIDNTLYFIENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 6686 - protein, 193 aa, Homo sapiens; identical to SEQ ID NO: 6684

SEQ ID NO: 6687 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 6688 - protein, 153 aa, Homo sapiens [sequence omitted]

SEQ ID NO: 6689 - protein, 137 aa, Homo sapiens
MGLTSQLLPPLFFLLACAGNFVHGHKCDITLQEIIKTLNSLTEQKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 6690 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 6691 - protein, 122 aa, Homo sapiens
MCESSKEALAENNLNLPKMAEKDGCFQSGFNEETCLVKIITGLLEFEVYLEYLQNRFESSEEQARAVQMSTKVLIQFLQKKVGVSSFPQLGVGEDRLKDSVLDNSGMQCHFQKRRLHVNKRV

SEQ ID NO: 6692 - protein, 212 aa, Homo sapiens; identical to SEQ ID NO: 6690

SEQ ID NO: 6693 - protein, 198 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKVGVSSFPQLGVGEDRLKDSVLDNSGMQCHFQKRRLHVNKRV

SEQ ID NO: 6694 - protein, 252 aa, Homo sapiens
MNSFSTSKCRKSLALELPAAVEPCVREGCVAQGGLAGGQQQRQAPSCAVSSPLRSLPSGTGAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKVGVSSFPQLGVGEDRLKDSVLDNSGMQCHFQKRRLHVNKRV

SEQ ID NO: 6695 - protein, 152 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQ

SEQ ID NO: 6696 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 6697 - protein, 712 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 6698 - protein, 693 aa, Homo sapiens
MAGGPGPGEPAAPGAQHFLYEVPPWVMCRFYKVMDALEPADWCQFGGWRRAAGGREARGLLAPTPDAPRPAAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 6699 - protein, 682 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 6700 - protein, 708 aa, Homo sapiens
MAGGPGPGEPAAPGAQHFLYEVPPWVMCRFYKVMDALEPADWCQFGGWRRAAGGREARGLLAPTPDAPRPAAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGVALRSTQSTLQAGLAADAWAAPIAMQIYKKHLDPRPGPCPPELGLGLGQLACCCLHRRAKRRPPMTQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 6701 - protein, 633 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQSFLTEVEQLSRFRHPNIVDFAGYCAQNGFYCLVYGFLPNGSLEDRLHCQTQACPPLSWPQRLDILLGTARAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLVYERLEKLQAVVAGVPGHSEAASCIPPSPQENSYVSSTGRAHSGAAPWQPLAAPSGASAQAAEQLQRGPNQPVESDESLGGLSAALRSWHLTPSCPLDPAPLREAGCPQGDTAGESSWGSGPGSRPTAVEGLALGSSASSSSEPPQIIINPARQKMVQKLALYEDGALDSLQLLSSSSLPGLGLEQDRQGPEESDEFQS

SEQ ID NO: 6702 - protein, 414 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYTPSDGTQKVTYLVHNFEEGGGVAMGMYNQDKSIEDFAHSSFQMALSKGWPLYLSTKNTILKKYDGRFKDIFQEIYDKQYKSQFEAQKIWYEHRLIDDMVAQAMKSEGGFIWACKNYDGDVQSDSVAQGYGSLGMMTSVLVCPDGKTVEAEAAHGTVTRHYRMYQKGQETSTNPIASIFAWTRGLAHRAKLDNNKELAFFANALEEVSIETIEAGFMTKDLAACIKGLPNVQRSDYLNTFEFMDKLGENLKIKLAQAKL

SEQ ID NO: 6703 - protein, 157 aa, Homo sapiens
MSKKISGGSVVEMQGDEMTRIIWELIKEKLIFPYVELDLHSYDLGIENRDATNDQVTKDAAEAIKKHNVGVKCATITPDEKRVEEFKLKQMWKSPNGTIRNILGGTVFREAIICKNIPRLVSGWVKPIIIGRHAYGDQYRATDFVVPGPGKVEITYT

SEQ ID NO: 6704 - protein, 414 aa, Homo sapiens; identical to SEQ ID NO: 6702

SEQ ID NO: 6705 - protein, 74 aa, Homo sapiens
MSKKISGGSVVEMQGDEMTRIIWELIKEKLIFPYVELDLHSYDLGIENRDATNDQVTKDAAEAIKKHNVGVKCA

SEQ ID NO: 6706 - protein, 414 aa, Homo sapiens; identical to SEQ ID NO: 6702

SEQ ID NO: 6707 - protein, 62 aa, Homo sapiens
MSKKISGGSVVEMQGDEMTRIIWELIKEKLIFPYVELDLHSYDLGIENRDATNDQVTKDAAE

SEQ ID NO: 6708 - protein, 452 aa, Homo sapiens
MAGYLRVVRSLCRASGSRPAWAPAALTAPTSQEQPRRHYADKRIKVAKPVVEMDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 6709 - protein, 322 aa, Homo sapiens
MWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 6710 - protein, 400 aa, Homo sapiens
MDGDEMTRIIWQFIKEKLILPHVDIQLKYFDLGLPNRDQTDDQVTIDSALATQKYSVAVKCATITPDEARVEEFKLKKMWKSPNGTIRNILGGTVFREPIICKNIPRLVPGWTKPITIGRHAHGDQYKATDFVADRAGTFKMVFTPKDGSGVKEWEVYNFPAGGVGMGMYNTDESISGFAHSCFQYAIQKKWPLYMSTKNTILKAYDGRFKDIFQEIFDKHYKTDFDKNKIWYEHRLIDDMVAQVLKSSGGFVWACKNYDGDVQSDILAQGFGSLGLMTSVLVCPDGKTIEAEAAHGTVTRHYREHQKGRPTSTNPIASIFAWTRGLEHRGKLDGNQDLIRFAQMLEKVCVETVESGAMTKDLAGCIHGLSNVKLNEHFLNTTDFLDTIKSNLDRALGRQ

SEQ ID NO: 6711 - protein, 1218 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 6712 - protein, 1059 aa, Homo sapiens
MINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 6713 - protein, 1132 aa, Homo sapiens
MGMACLTMTEMEGTSTSSIYQNGDISGNANSMKQIDPVLQVYLYHSLGKSEADYLTFPSGEYVAEEICIAASKACGITPVYHNMFALMSETERIWYPPNHVFHIDESTRHNVLYRIRFYFPRWYCSGSNRAYRHGISRGAEAPLLDDFVMSYLFAQWRHDFVHGWIKVPVTHETQEECLGMAVLDMMRIAKENDQTPLAIYNSISYKTFLPKCIRAKIQDYHILTRKRIRYRFRRFIQQFSQCKATARNLKLKYLINLETLQSAFYTEKFEVKEPGSGPSGEEIFATIIITGNGGIQWSRGKHKESETLTEQDLQLYCDFPNIIDVSIKQANQEGSNESRVVTIHKQDGKNLEIELSSLREALSFVSLIDGYYRLTADAHHYLCKEVAPPAVLENIQSNCHGPISMDFAISKLKKAGNQTGLYVLRCSPKDFNKYFLTFAVERENVIEYKHCLITKNENEEYNLSGTKKNFSSLKDLLNCYQMETVRSDNIIFQFTKCCPPKPKDKSNLLVFRTNGVSDVPTSPTLQRPTHMNQMVFHKIRNEDLIFNESLGQGTFTKIFKGVRREVGDYGQLHETEVLLKVLDKAHRNYSESFFEAASMMSKLSHKHLVLNYGVCVCGDENILVQEFVKFGSLDTYLKKNKNCINILWKLEVAKQLAWAMHFLEENTLIHGNVCAKNILLIREEDRKTGNPPFIKLSDPGISITVLPKDILQERIPWVPPECIENPKNLNLATDKWSFGTTLWEICSGGDKPLSALDSQRKLQFYEDRHQLPAPKWAELANLINNCMDYEPDFRPSFRAIIRDLNSLFTPDYELLTENDMLPNMRIGALGFSGAFEDRDPTQFEERHLKFLQQLGKGNFGSVEMCRYDPLQDNTGEVVAVKKLQHSTEEHLRDFEREIEILKSLQHDNIVKYKGVCYSAGRRNLKLIMEYLPYGSLRDYLQKHKERIDHIKLLQYTSQICKGMEYLGTKRYIHRDLATRNILVENENRVKIGDFGLTKVLPQDKEYYKVKEPGESPIFWYAPESLTESKFSVASDVWSFGVVLYELFTYIEKSKSPPAEFMRMIGNDKQGQMIVFHLIELLKNNGRLPRPDGCPDEIYMIMTECWNNNVNQRPSFRDLALRVDQIRDNMAG

SEQ ID NO: 6714 - protein, 1132 aa, Homo sapiens; identical to SEQ ID NO: 6713

SEQ ID NO: 6715 - protein, 983 aa, Homo sapiens
MSYLFAQWRHDFVHGWIKVPVTHETQEECLGMAVLDMMRIAKENDQTPLAIYNSISYKTFLPKCIRAKIQDYHILTRKRIRYRFRRFIQQFSQCKATARNLKLKYLINLETLQSAFYTEKFEVKEPGSGPSGEEIFATIIITGNGGIQWSRGKHKESETLTEQDLQLYCDFPNIIDVSIKQANQEGSNESRVVTIHKQDGKNLEIELSSLREALSFVSLIDGYYRLTADAHHYLCKEVAPPAVLENIQSNCHGPISMDFAISKLKKAGNQTGLYVLRCSPKDFNKYFLTFAVERENVIEYKHCLITKNENEEYNLSGTKKNFSSLKDLLNCYQMETVRSDNIIFQFTKCCPPKPKDKSNLLVFRTNGVSDVPTSPTLQRPTHMNQMVFHKIRNEDLIFNESLGQGTFTKIFKGVRREVGDYGQLHETEVLLKVLDKAHRNYSESFFEAASMMSKLSHKHLVLNYGVCVCGDENILVQEFVKFGSLDTYLKKNKNCINILWKLEVAKQLAWAMHFLEENTLIHGNVCAKNILLIREEDRKTGNPPFIKLSDPGISITVLPKDILQERIPWVPPECIENPKNLNLATDKWSFGTTLWEICSGGDKPLSALDSQRKLQFYEDRHQLPAPKWAELANLINNCMDYEPDFRPSFRAIIRDLNSLFTPDYELLTENDMLPNMRIGALGFSGAFEDRDPTQFEERHLKFLQQLGKGNFGSVEMCRYDPLQDNTGEVVAVKKLQHSTEEHLRDFEREIEILKSLQHDNIVKYKGVCYSAGRRNLKLIMEYLPYGSLRDYLQKHKERIDHIKLLQYTSQICKGMEYLGTKRYIHRDLATRNILVENENRVKIGDFGLTKVLPQDKEYYKVKEPGESPIFWYAPESLTESKFSVASDVWSFGVVLYELFTYIEKSKSPPAEFMRMIGNDKQGQMIVFHLIELLKNNGRLPRPDGCPDEIYMIMTECWNNNVNQRPSFRDLALRVDQIRDNMAG

SEQ ID NO: 6716 - protein, 243 aa, Homo sapiens
MTGIAAASFFSNTCRFGGCGLHFPTLADLIEHIEDNHIDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 6717 - protein, 347 aa, Homo sapiens
MCTKMEQPFYHDDSYTATGYGRAPGGLSLHDYKLLKPSLAVNLADPYRSLKAPGARGPGPEGGGGGSYFSGQGSDTGASLKLASSELERLIVPNSNGVITTTPTPPGQYFYPRGGGSGGGAGGAGGGVTEEQEGFADGFVKALDDLHKMNHVTPPNVSLGATGGPPAGPGGVYAGPEPPPVYTNLSSYSPASASSGGAGAAVGTGSSYPTTTISYLPHAPPFAGGHPAQLGLGRGASTFKEEPQTVPEARSRDATPPVSPINMEDQERIKVERKRLRNRLAATKCRKRKLERIARLEDKVKTLKAENAGLSSTAGLLREQVAQLKQKVMTHVSNGCQLLLGVKGHAF

SEQ ID NO: 6718 - protein, 331 aa, Homo sapiens
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 6719 - protein, 276 aa, Homo sapiens
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVLGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 6720 - protein, 276 aa, Homo sapiens; identical to SEQ ID NO: 6719

SEQ ID NO: 6721 - protein, 276 aa, Homo sapiens; identical to SEQ ID NO: 6719

SEQ ID NO: 6722 - protein, 218 aa, Homo sapiens
MWVPVVFLTLSVTWIGAAPLILSRIVGGWECEKHSQPWQVLVASRGRAVCGGVLVHPQWVLTAAHCIRKPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 6723 - protein, 529 aa, Homo sapiens [sequence omitted]

SEQ ID NO: 6724 - protein, 529 aa, Homo sapiens [sequence omitted]

SEQ ID NO: 6725 - protein, 655 aa, Homo sapiens
MPLKWKTSSPAIWKFPVPVLKTSRSTPLSPAYISLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 6726 - protein, 604 aa, Homo sapiens
MGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 6727 - protein, 604 aa, Homo sapiens; identical to SEQ ID NO: 6726

SEQ ID NO: 6728 - protein, 604 aa, Homo sapiens; identical to SEQ ID NO: 6726

SEQ ID NO: 6729 - protein, 604 aa, Homo sapiens; identical to SEQ ID NO: 6726

SEQ ID NO: 6730 - protein, 38 aa, Homo sapiens
MGLSSHLQSSKAGPTRIFTSNTHSSVVLQGFDQLRLEG

SEQ ID NO: 6731 - protein, 604 aa, Homo sapiens; identical to SEQ ID NO: 6726

SEQ ID NO: 6732 - protein, 658 aa, Homo sapiens
MMRVQTLREKWAYWRRRQLSLKQADFKDIFKKSTSGSLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 6733 - protein, 639 aa, Homo sapiens
MDHLHRGELVAAILRNRSLVEEEDQHMKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 6734 - protein, 639 aa, Homo sapiens; identical to SEQ ID NO: 6733

SEQ ID NO: 6735 - protein, 613 aa, Homo sapiens
MKLSLGGSEMGLSSHLQSSKAGPTRIFTSNTHSSVVLQGFDQLRLEGLLCDVTLMPGDTDDAFPVHRVMMASASDYFKAMFTGGMKEQDLMCIKLHGVSKVGLRKIIDFIYTAKLSLNMDNLQDTLEAASFLQILPVLDFCKVFLISGVTLDNCVEVGRIANTYNLTEVDKYVNSFVLKNFPALLSTGEFLKLPFERLAFVLSSNSLKHCTELELFKATCRWLRLEEPRMDFAAKLMKNIRFPLMTPQELINYVQTVDFMRTDNTCVNLLLEASNYQMMPYMQPVMQSDRTAIRSDTTHLVTLGGVLRQQLVVSKELRMYDEKAHEWKSLAPMDAPRYQHGIAVIGNFLYVVGGQSNYDTKGKTAVDTVFRFDPRYNKWMQVASLNEKRTFFHLSALKGYLYAVGGRNAAGELPTVECYNPRTNEWTYVAKMSEPHYGHAGTVYGGVMYISGGITHDTFQKELMCFDPDTDKWIQKAPMTTVRGLHCMCTVGERLYVIGGNHFRGTSDYDDVLSCEYYSPILDQWTPIAAMLRGQSDVGVAVFENKIYVVGGYSWNNRCMVEIVQKYDPDKDEWHKVFDLPESLGGIRACTLTVFPPEETTPSPSRESPLSAP

SEQ ID NO: 6736 - protein, 472 aa, Homo sapiens
MTTCSRQFTSSSSMKGSCGIGGGIGGGSSRISSVLAGGSCRAPSTYGGGLSVSSSRFSSGGACGLGGGYGGGFSSSSSSFGSGFGGGYGGGLGAGLGGGFGGGFAGGDGLLVGSEKVTMQNLNDRLASYLDKVRALEEANADLEVKIRDWYQRQRPAEIKDYSPYFKTIEDLRNKILTATVDNANVLLQIDNARLAADDFRTKYETELNLRMSVEADINGLRRVLDELTLARADLEMQIESLKEELAYLKKNHEEEMNALRGQVGGDVNVEMDAAPGVDLSRILNEMRDQYEKMAEKNRKDAEEWFFTKTEELNREVATNSELVQSGKSEISELRRTMQNLEIELQSQLSMKASLENSLEETKGRYCMQLAQIQEMIGSVEEQLAQLRCEMEQQNQEYKILLDVKTRLEQEIATYRRLLEGEDAHLSSSQFSSGSQSSRDVTSSSRQIRTKVMDVHDGKVVSTHEQVLRTKN

SEQ ID NO: 6737 - protein, 430 aa, Homo sapiens
MSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 6738 - protein, 430 aa, Homo sapiens; identical to SEQ ID NO: 6737

SEQ ID NO: 6739 - protein, 400 aa, Homo sapiens
MTSYSYRQSSATSSFGGLGGGSVRFGPGVAFRAPSIHGGSGGRGVSVSSARFVSSSSSGAYGGGYGGVLTASDGLLAGNEKLTMQNLNDRLASYLDKVRALEAANGELEVKIRDWYQKQGPGPSRDYSHYYTTIQDLRDKILGATIENSRIVLQIDNARLAADDFRTKFETEQALRMSVEADINGLRRVLDELTLARTDLEMQIEGLKEELAYLKKNHEEEISTLRGQVGGQVSVEVDSAPGTDLAKILSDMRSQYEVMAEQNRKDAEAWFTSRTEELNREVAGHTEQLQMSRSEVTDLRRTLQGLEIELQSQLSMKAALEDTLAETEARFGAQLAHIQALISGIEAQLGDVRADSERQNQEYQRLMDIKSRLEQEIATYRSLLEGQEDHYNNLSASKVL

SEQ ID NO: 6740 - protein, 196 aa, Homo sapiens
MTSYSYRQSSATSSFGGLGGGSVRFGPGVAFRAPSIHGGSGGRGVSVSSARFVSSSSSGAYGGGYGGVLTASDGLLAGNEKLTMQNLNDRLASYLDKVRALEAANGELEILGATIENSRIVLQIDNARLAADDFRTKFETEQALRMSVEADINGLRRVLDELTLARTDLEMQIEGLKEELAYLKKNHEEEISTLRG

SEQ ID NO: 6741 - protein, 590 aa, Homo sapiens
MSRQSSVSFRSGGSRSFSTASAITPSVSRTSFTSVSRSGGGGGGGFGRVSLAGACGVGGYGSRSLYNLGGSKRISISTSGGSFRNRFGAGAGGGYGFGGGAGSGFGFGGGAGGGFGLGGGAGFGGGFGGPGFPVCPPGGIQEVTVNQSLLTPLNLQIDPSIQRVRTEEREQIKTLNNKFASFIDKVRFLEQQNKVLDTKWTLLQEQGTKTVRQNLEPLFEQYINNLRRQLDSIVGERGRLDSELRNMQDLVEDFKNKYEDEINKRTTAENEFVMLKKDVDAAYMNKVELEAKVDALMDEINFMKMFFDAELSQMQTHVSDTSVVLSMDNNRNLDLDSIIAEVKAQYEEIANRSRTEAESWYQTKYEELQQTAGRHGDDLRNTKHEISEMNRMIQRLRAEIDNVKKQCANLQNAIADAEQRGELALKDARNKLAELEEALQKAKQDMARLLREYQELMNTKLALDVEIATYRKLLEGEECRLSGEGVGPVNISVVTSSVSSGYGSGSGYGGGLGGGLGGGLGGGLAGGSSGSYYSSSSGGVGLGGGLSVGGSGFSASSGRGLGVGFGSGGGSSSSVKFVSTTSSSRKSFKS

SEQ ID NO: 6742 - protein, 555 aa, Homo sapiens
MSRQSSVSFRSGGSRSFSTASAITPSVSRTSFTSVSRSGGGGGGGFGRVSLAGACGVGGYGFGGGAGSGFGFGGGAGGGFGLGGGAGFGGGFGGPGFPVCPPGGIQEVTVNQSLLTPLNLQIDPSIQRVRTEEREQIKTLNNKFASFIDKVRFLEQQNKVLDTKWTLLQEQGTKTVRQNLEPLFEQYINNLRRQLDSIVGERGRLDSELRNMQDLVEDFKNKYEDEINKRTTAENEFVMLKKDVDAAYMNKVELEAKVDALMDEINFMKMFFDAELSQMQTHVSDTSVVLSMDNNRNLDLDSIIAEVKAQYEEIANRSRTEAESWYQTKYEELQQTAGRHGDDLRNTKHEISEMNRMIQRLRAEIDNVKKQCANLQNAIADAEQRGELALKDARNKLAELEEALQKAKQDMARLLREYQELMNTKLALDVEIATYRKLLEGEECRLSGEGVGPVNISVVTSSVSSGYGSGSGYGGGLGGGLGGGLGGGLAGGSSGSYYSSSSGGVGLGGGLSVGGSGFSASSGRGLGVGFGSGGGSSSSVKFVSTTSSSRKSFKS

SEQ ID NO: 6743 - protein, 132 aa, Homo sapiens
MSRQSSVSFRSGGSRSFSTASAITPSVSRTSFTSVSRSGGGGGGGFGRVSLAGACGVGGYGSRSLYNLGGSKRISISTSGGSFRNRFGAGAGGGYGFGGGAGSGFGFGGGAGGGFGLGGGAGFGGGFGGPGF

SEQ ID NO: 6744 - protein, 469 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINHRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRGKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 6745 - protein, 445 aa, Homo sapiens
MSIHFSSPVFTSRSAAFSGRGAQVRLSSARPGGLGSSSLYGLGASRPRVAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNRYEDEINHRTAAENEFVVLKKDVDAAYMSKVELEAKVDALNDEINFLRTLNETELTELQSQISDTSVVLSMDNSRSLDLDGIIAEVKAQYEEMAKCSRAEAEAWYQTKFETLQAQAGKHGDDLRNTRNEISEMNRAIQRLQAEIDNIKNQRAKLEAAIAEAEERGELALKDARAKQEELEAALQRGKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 6746 - protein, 403 aa, Homo sapiens
MSIHFSSPVFTSRSAAFSGRGAQVRLSSARPGGLGSSSLYGLGASRPRVAVRSAYGGPVGAGIREVTINQSLLAPLRLDADPSLQRVRQEESEQIKTLNNKFASFIDKVRFLEQQNKLLETKWTLLQEQKSAKSSRLPDIFEAQIAGLRGQLEALQVDGGRLEAELRSMQDVVEDFKNKYEDEINHRTAAENEFVVLKKDVDAAYMSKVELEAKVDALNDEINFLRTLNETEIHVLQSHISDTSVVVKLDNSQDLNMDCIIAEIKAQYDDIVTCSWAKAESWYHGCLEMKATVIWHGETVGCTKEEIKELTHMIQRLMAKVENAKCQNSKLEVEVTQSEQQGEVALSDNRCKLVELEGTMQKARQYQEVMNSKLGLNVKAASSCHLLDGEEQRLCDGISAVNI

SEQ ID NO: 6747 - protein, 483 aa, Homo sapiens
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 6748 - protein, 273 aa, Homo sapiens
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANR

SEQ ID NO: 6749 - protein, 483 aa, Homo sapiens; identical to SEQ ID NO: 6747

SEQ ID NO: 6750 - protein, 177 aa, Homo sapiens
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKN

SEQ ID NO: 6751 - protein, 511 aa, Homo sapiens
MNGVSWSQDLQEGISAWFGPPASTPASTMSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTSGYAGGLSSAYGGLTSPGLSYSLGSSFGSGAGSSSFSRTSSSRAVVVKKIETRDGKLVSESSDVLPK

SEQ ID NO: 6752 - protein, 483 aa, Homo sapiens; identical to SEQ ID NO: 6747

SEQ ID NO: 6753 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 6754 - protein, 2209 aa, Homo sapiens
MWNDIELLTNDDTGSGYLSVGSRKEHGTALYQVDLLVKISSEKASLNPKIQACSLSDGFIIVADQSVILLDSICRSLQLHLVFDTEVDVVGLCQEGKFLLVGERSGNLHLIHVTSKQTLLTNAFVQKANDENRRTYQNLVIEKDGSNEGTYYMLLLTYSGFFCITNLQLLKIQQAIENVDFSTAKKLQGQIKSSFISTENYHTLGCLSLVAGDLASEVPVIIGGTGNCAFSKWEPDSSKKGMTVKNLIDAEIIKGAKKFQLIDNLLFVLDTDNVLSLWDIYTLTPVWNWPSLHVEEFLLTTEADSPSSVTWQGITNLKLIALTASANKKMKNLMVYSLPTMEILYSLEVSSVSSLVQTGISTDTIYLLEGVCKNDPKLSEDSVSVLVLRCLTEALPENRLSRLLHKHRFAEAESFAIQFGLDVELVYKVKSNHILEKLALSSVDASEQTEWQQLVDDAKENLHKIQDDEFVVNYCLKAQWITYETTQEMLNYAKTRLLKKEDKTALIYSDGLKEVLRAHAKLTTFYGAFGPEKFSGSSWIEFLNNEDDLKDIFLQLKEGNLVCAQYLWLRHRANFESRFDVKMLESLLNSMSASVSLQKLCPWFKNDVIPFVRRTVPEGQIILAKWLEQAARNLELTDKANWPENGLQLAEIFFTAEKTDELGLASSWHWISLKDYQNTEEVCQLRTLVNNLRELITLHRKYNCKLALSDFEKENTTTIVFRMFDKVLAPELIPSILEKFIRVYMREHDLQEEELLLLYIEDLLNRCSSKSTSLFETAWEAKAMAVIACLSDTDLIFDAVLKIMYAAVVPWSAAVEQLVKQHLEMDHPKVKLLQESYKLMEMKKLLRGYGIREVNLLNKEIMRVVRYILKQDVPSSLEDALKVAQAFMLSDDEIYSLRIIDLIDREQGEDCLLLLKSLPPAEAEKTAERVIIWARLALQEEPDHSKEGKAWRMSVAKTSVDILKILCDIQKDNLQKKDECEEMLKLFKEVASLQENFEVFLSFEDYSNSSLVADLREQHIKAHEVAQAKHKPGSTPEPIAAEVRSPSMESKLHRQALALQMSKQELEAELTLRALKDGNIKTALKKCSDLFKYHCNADTGKLLFLTCQKLCQMLADNVPVTVPVGLNLPSMIHDLASQAATICSPDFLLDALELCKHTLMAVELSRQCQMDDCGILMKASFGTHKDPYEEWSYSDFFSEDGIVLESQMVLPVIYELISSLVPLAESKRYPLESTSLPYCSLNEGDGLVLPVINSISALLQNLQESSQWELALRFVVGSFGTCLQHSVSNFMNATLSEKLFGETTLVKSRHVVMELKEKAVIFIRENATTLLHKVFNCRLVDLDLALGYCTLLPQKDVFENLWKLIDKAWQNYDKILAISLVGSELASLYQEIEMGLKFRELSTDAQWGIRLGKLGISFQPVFRQHFLTKKDLIKALVENIDMDTSLILEYCSTFQLDCDAVLQLFIETLLHNTNAGQGQGDASMDSAKRRHPKLLAKALEMVPLLTSTKDLVISLSGILHKLDPYDYEMIEVVLKVIERADEKITNININQALSILKHLKSYRRISPPVDLEYQYMLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQVPYFSKAWQRVIQIPLLSASCPLSPDQLSDCSESLIAVLECPVSGDLDLIGVARQYIQLELPAFALACLMLMPHSEKRHQQIKNFLGSCDPQVILKQLEEHMNTGQLAGFSHQIRSLILNNIINKKEFGILAKTKYFQMLKMHAMNTNNITELVNYLANDLSLDEASVLITEYSKHCGKPVPPDTAPCEILKMFLSGLS

SEQ ID NO: 6755 - protein, 443 aa, Homo sapiens
MLEHVITLPSAAQTRLPFHLIFFGTAQNFWKILSTELSEESFPTLLLISKLMKFSLDTLYVSTAKHVFEKKLKPKLLKLTQAKSSTLINKEITKITQTIESCLLSIVNPEWAVAIAISLAQDIPEGSFKISALKFCLYLAERWLQNIPSQDEKREKAEALLKKLHIQYRRSGTEAVLIAHKLNTEEYLRVIGKPAHLIVSLYEHPSINQRIQNSSGTDYPDIHAAAKEIAEVNEINLEKVWDMLLEKWLCPSTKPGEKPSELFELQEDEALRRVQYLLLSRPIDYSSRMLFVFATSTTTTLGMHQLTFAHRTRALQCLFYLADKETIESLFKKPIEEVKSYLRCITFLASFETLNIPITYELFCSSPKEGMIKGLWKNHSHESMAVRLVTELCLEYKIYDLQLWNGLLQKLLGFNMIPYLRKVLKAISSIHSLWQRWRSCYVA

SEQ ID NO: 6756 - protein, 138 aa, Homo sapiens
MNSLVSWQLLLFLCATHFGEPLEKVASVGNSRPTGQQLESLGLLAPGEQSLPCTERKPAATARLSRRGTSLSPPPESSGSPQQPGLSAPHSRQIPAPQGAVLVQREKDLPNYNWNSFGLRFGKREAAPGNHGRSAGRG

SEQ ID NO: 6757 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 6758 - protein, 978 aa, Homo sapiens
MAHTTKVNGSASGKAGDILSGDQDKEQKDPYFVETPYGYQLDLDFLKYVDDIQKGNTIKRLNIQKRRKPSVPCPEPRTTSGQQGIWTSTESLSSSNSDDNKQCPNFLIARSQVTSTPISKPPPPLETSLPFLTIPENRQLPPPSPQLPKHNLHVTKTLMETRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIESLKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYGNFSHSQSLASGF

SEQ ID NO: 6759 - protein, 276 aa, Homo sapiens
MLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPVSVVHLAFVNRLKSTRLVDPLPPGIDGRQILC

SEQ ID NO: 6760 - protein, 330 aa, Homo sapiens
MAEGHHAVNIEGLKSARVEDEMQVQECEPEKVEIRERYELSEKMLSACNLLKNTINDPKALTSKDMGQVQWLTPMIPTLREADAGGSHERFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 6761 - protein, 1194 aa, Homo sapiens
METRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIESLKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYACTNNESTLKSIMKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 6762 - protein, 1352 aa, Homo sapiens
MAHTTKVNGSASGKAGDILSGDQDKEQKDPYFVETPYGYQLDLDFLKYVDDIQKGNTIKRLNIQKRRKPSVPCPEPRTTSGQQGIWTSTESLSSSNSDDNKQCPNFLIARSQVTSTPISKPPPPLETSLPFLTIPENRQLPPPSPQLPKHNLHVTKTLMETRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIESLKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYACTNNESTLKSIMKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 6763 - protein, 1352 aa, Homo sapiens; identical to SEQ ID NO: 6762

SEQ ID NO: 6764 - protein, 398 aa, Homo sapiens
MKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMGQVQWLTPMIPTLREADAGGSHERFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 6765 - protein, 736 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 6766 - protein, 688 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 6767 - protein, 736 aa, Homo sapiens; identical to SEQ ID NO: 6765

SEQ ID NO: 6768 - protein, 736 aa, Homo sapiens; identical to SEQ ID NO: 6765

SEQ ID NO: 6769 - protein, 736 aa, Homo sapiens; identical to SEQ ID NO: 6765

SEQ ID NO: 6770 - protein, 69 aa, Homo sapiens
MGNPENIEDAYVAVIRPKNTASLNSREYRAKSYEILLHEVPIEGQKKKRKKVLLETKLQGNSEITQGIL

SEQ ID NO: 6771 - protein, 565 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKERQWVDDFPLHRSACEGDSELLSRLLSERFSVNQLDSDHWAPIHYACWYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQSLWKL

SEQ ID NO: 6772 - protein, 25 aa, Homo sapiens
MGNPENIEDAYVAVIRPKNTASLNS

SEQ ID NO: 6773 - protein, 12 aa, Homo sapiens
MGNPENIEDAYV

SEQ ID NO: 6774 - protein, 38 aa, Homo sapiens
MGNPENIEDAYVAVIRPKNTASLNSREYRAKSYEILLH

SEQ ID NO: 6775 - protein, 98 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFP

SEQ ID NO: 6776 - protein, 184 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLE

SEQ ID NO: 6777 - protein, 112 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFI

SEQ ID NO: 6778 - protein, 34 aa, Homo sapiens
MGNPENIEDAYVAVIRPKNTASLNSREYRAKSYE

SEQ ID NO: 6779 - protein, 58 aa, Homo sapiens
MGNPENIEDAYVAVIRPKNTASLNSREYRAKSYEILLHEVPIEGQKKKRKKVLLETKL

SEQ ID NO: 6780 - protein, 162 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDK

SEQ ID NO: 6781 - protein, 243 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNR

SEQ ID NO: 6782 - protein, 65 aa, Homo sapiens
MGNPENIEDAYVAVIRPKNTASLNSREYRAKSYEILLHEVPIEGQKKKRKKVLLETKLQGNSEIT

SEQ ID NO: 6783 - protein, 362 aa, Homo sapiens
MATAETALPSISTLTALGPFPDTQDDFLKWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGAGSSGGYFPRTGLSVPAASGAPYGLLSGYPAMYPAPQYQGHFQLFRGLQGPAPGPATSPSFLSCLGPGTVGTGLGGTAEDPGVIAETAPSKRGRRSWARKRQAAHTCAHPGCGKSYTKSSHLKAHLRTHTGEKPYACTWEGCGWRFARSDELTRHYRKHTGQRPFRCQLCPRAFSRSDHLALHMKRHL

SEQ ID NO: 6784 - protein, 332 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 6785 - protein, 274 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKECRYTLGDPKGAAILKSSDVISFHCLGYNRILGGGCACCPFYLICD

SEQ ID NO: 6786 - protein, 332 aa, Homo sapiens; identical to SEQ ID NO: 6784

SEQ ID NO: 6787 - protein, 274 aa, Homo sapiens
MATLKDQLIYNLLKEEQTPQNKITVVGVGAVGMACAISILMKDLADELALVDVIEDKLKGEMMDLQHGSLFLRTPKIVSGKVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 6788 - protein, 305 aa, Homo sapiens
MATLKDQLIYNLLKEEQTPQNKITVVGVGAVGMACAISILMKDLADELAIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 6789 - protein, 144 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPGEAFD

SEQ ID NO: 6790 - protein, 114 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNV

SEQ ID NO: 6791 - protein, 72 aa, Homo sapiens
MATLKDQLIYNLLKEEQTPQNKITVVGVGAVGMACAISILMKDLADELALVDVIEDKLKGEMMDLQHGSLFL

SEQ ID NO: 6792 - protein, 361 aa, Homo sapiens
MGEPSGGYTYTQTSIFLFHAKIPFGSKSNMATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 6793 - protein, 332 aa, Homo sapiens; identical to SEQ ID NO: 6784

SEQ ID NO: 6794 - protein, 157 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNR

SEQ ID NO: 6795 - protein, 241 aa, Homo sapiens
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVERVFTE

SEQ ID NO: 6796 - protein, 1130 aa, Homo sapiens
MKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHPSNGQRVNPPPPPQVRSVTPPPPPRGQTPPPRGTTPPPPSWEPNSQTKRYSGNMEYVISRISPVPPGAWQEGYPPPPLNTSPMNPPNQGQRGISSVPVGRQPIIMQSSSKFNFPSGRPGMQNGTGQTDFMIHQNVVPAGTVNRQPPPPYPLTAANGQSPSALQTGGSAAPSSYTNGSIPQSMMVPNRNSHNMELYNISVPGLQTNWPQSSSAPAQSSPSSGHEIPTWQPNIPVRSNSFNNPLGNRASHSANSQPSATTVTAITPAPIQQPVKSMRVLKPELQTALAPTHPSWIPQPIQTVQPSPFPEGTASNVTVMPPVAEAPNYQGPPPPYPKHLLHQNPSVPPYESISKPSKEDQPSLPKEDESEKSYENVDSGDKEKKQITTSPITVRKNKKDEERRESRIQSYSPQAFKFFMEQHVENVLKSHQQRLHRKKQLENEMMRVGLSQDAQDQMRKMLCQKESNYIRLKRAKMDKSMFVKIKTLGIGAFGEVCLARKVDTKALYATKTLRKKDVLLRNQVAHVKAERDILAEADNEWVVRLYYSFQDKDNLYFVMDYIPGGDMMSLLIRMGIFPESLARFYIAELTCAVESVHKMGFIHRDIKPDNILIDRDGHIKLTDFGLCTGFRWTHDSKYYQSGDHPRQDSMDFSNEWGDPSSCRCGDRLKPLERRAARQHQRCLAHSLVGTPNYIAPEVLLRTGYTQLCDWWSVGVILFEMLVGQPPFLAQTPLETQMKVINWQTSLHIPPQAKLSPEASDLIIKLCRGPEDRLGKNGADEIKAHPFFKTIDFSSDLRQQSASYIPKITHPTDTSNFDPVDPDKLWSDDNEEENVNDTLNGWYKNGKHPEHAFYEFTFRRFFDDNGYPYNYPKPIEYEYINSQGSEQQSDEDDQNTGSEIKNRDLVYV

SEQ ID NO: 6797 - protein, 690 aa, Homo sapiens
MKRSEKPEGYRQMRPKTFPASNYTVSSRQMLQEIRESLRNLSKPSDAAKAEHNMSKMSTEDPRQVRNPPKFGTHHKALQEIRNSLLPFANETNSSRSTSEVNPQMLQDLQAAGFDEDMVIQALQKTNNRSIEAAIEFISKMSYQDPRREQMAAAAARPINASMKPGNVQQSVNRKQSWKGSKESLVPQRHGPPLGESVAYHSESPNSQTDVGRPLSGSGISAFVQAHPSNGQRVNPPPPPQVRSVTPPPPPRGQTPPPRGTTPPPPSWEPNSQTKRYSGNMEYVISRISPVPPGAWQEGYPPPPLNTSPMNPPNQGQRGISSVPVGRQPIIMQSSSKFNFPSGRPGMQNGTGQTDFMIHQNVVPAGTVNRQPPPPYPLTAANGQSPSALQTGGSAAPSSYTNGSIPQSMMVPNRNSHNMELYNISVPGLQTNWPQSSSAPAQSSPSSGHEIPTWQPNIPVRSNSFNNPLGNRASHSANSQPSATTVTAITPAPIQQPVKSMRVLKPELQTALAPTHPSWIPQPIQTVQPSPFPEGTASNVTVMPPVAEAPNYQGPPPPYPKHLLHQNPSVPPYESISKPSKEDQPSLPKEDESEKSYENVDSGDKEKKQITTSPITVRKNKKDEERRESRIQSYSPQAFKFFMEQHVENVLKSHQQRLHRKKQLENEMMRVKPFKMSIFILNHLFAWCLF

SEQ ID NO: 6798 - protein, 1130 aa, Homo sapiens; identical to SEQ ID NO: 6796

SEQ ID NO: 6799 - protein, 1088 aa, Homo sapiens
MRPKTFPATTYSGNSRQRLQEIREGLKQPSKSSVQGLPAGPNSDTSLDAKVLGSKDATRQQQQMRATPKFGPYQKALREIRYSLLPFANESGTSAAAEVNRQMLQELVNAGCDQEMAGRALKQTGSRSIEAALEYISKMGYLDPRNEQIVRVIKQTSPGKGLMPTPVTRRPSFEGTGDSFASYHQLSGTPYEGPSFGADGPTALEEMPRPYVDYLFPGVGPHGPGHQHQHPPKGYGASVEAAGAHFPLQGAHYGRPHLLVPGEPLGYGVQRSPSFQSKTPPETGGYASLPTKGQGGPPGAGLAFPPPAAGLYVPHPHHKQAGPAAHQLHVLGSRSQVFASDSPPQSLLTPSRNSLNVDLYELGSTSVQQWPAATLARRDSLQKPGLEAPPRAHVAFRPDCPVPSRTNSFNSHQPRPGPPGKAEPSLPAPNTVTAVTAAHILHPVKSVRVLRPEPQTAVGPSHPAWVPAPAPAPAPAPAPAAEGLDAKEEHALALGGAGAFPLDVEYGGPDRRCPPPPYPKHLLLRSKSEQYDLDSLCAGMEQSLRAGPNEPEGGDKSRKSAKGDKGGKDKKQIQTSPVPVRKNSRDEEKRESRIKSYSPYAFKFFMEQHVENVIKTYQQKVNRRLQLEQEMAKAGLCEAEQEQMRKILYQKESNYNRLKRAKMDKSMFVKIKTLGIGAFGEVCLACKVDTHALYAMKTLRKKDVLNRNQVAHVKAERDILAEADNEWVVKLYYSFQDKDSLYFVMDYIPGGDMMSLLIRMEVFPEHLARFYIAELTLAIESVHKMGFIHRDIKPDNILIDLDGHIKLTDFGLCTGFRWTHNSKYYQKGSHVRQDSMEPSDLWDDVSNCRCGDRLKTLEQRARKQHQRCLAHSLVGTPNYIAPEVLLRKGYTQLCDWWSVGVILFEMLVGQPPFLAPTPTETQLKVINWENTLHIPAQVKLSPEARDLITKLCCSADHRLGRNGADDLKAHPFFSAIDFSSDIRKQPAPYVPTISHPMDTSNFDPVDEESPWNDASEGSTKAWDTLTSPNNKHPEHAFYEFTFRRFFDDNGYPFRCPKPSGAEASQAESSDLESSDLVDQTEGCQPVYV

SEQ ID NO: 6800 - protein, 1088 aa, Homo sapiens; identical to SEQ ID NO: 6799

SEQ ID NO: 6801 - protein, 323 aa, Homo sapiens
MAYVPAPGYQPTYNPTLPYYQPIPGGLNVGMSVYIQGVASEHMKRFFVNFVVGQDPGSDVAFHFNPRFDGWDKVVFNTLQGGKWGSEERKRSMPFKKGAAFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 6802 - protein, 509 aa, Homo sapiens
MNNEEDLLQEDSTRDEGNETEANSMNTLRRTRKKVTKPYVCSTEVGETDMSNSNDCMRDSSQILTPPQLSSRMKHIRQAMAKNRLQFVRFEATDLHGVSRSKTIPAHFFQEKVSHGVCMPRGYLEVIPNPKDNEMNNIRATCFNSDIVLMPELSTFRVLPWADRTARVICDTFTVTGEPLLTSPRYIAKRQLSHLQASGFSLLSAFIYDFCIFGVPEILNSKIISFPALTFLNNHDQPFMQELVDGLYHTGANVESFSSSTRPGQMEISFLPEFGISSADNAFTLRTGVKEVARKYNYIASFFIETGFCDSGILSHSLWDVDRKKNMFCSTSGTEQLTITGKKWLAGLLKHSAALSCLMAPSVSCRKRYSKDRKDLKKSVPTTWGYNDNSCIFNIKCHGEKGTRIENKLGSATANPYLVLAATVAAGLDGLHSSNEVLAGPDESTDFYQVEPSEIPLKLEDALVALEEDQCLRQALGETFIRYFVAMKKYELENEEIAAERNKFLEYFI

SEQ ID NO: 6803 - protein, 208 aa, Homo sapiens
MNNEEDLLQEDSTRDEGNETEANSMNTLRRTRKKVTKPYVCSTEVGETDMSNSNDCMRDSSQILTPPQLSSRMKHIRQAMAKNRLQFVRFEATDLHGVSRSKTIPAHFFQEKVSHGVCMPRGYLEVIPNPKDNEMNNIRATCFNSDIVLMPELSTFRVLPWADRTARVICDTFTVTVSGMSIGRKTCSAALLELSSSRSLGKNGWQDS

SEQ ID NO: 6804 - protein, 167 aa, Homo sapiens
MHWGTLCGFLWLWPYLFYVQAVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 6805 - protein, 596 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQRKKNEAELLREKVNLLEQELQELRAQAALARDMGPPTFPEDVPALQRELERLRAELREERQGHDQMSSGFQHERLVWKEEKEKVIQYQKQLQQSYVAMYQRNQRLEKALQQLARGDSAGEPLEVDLEGADIPYEDIIATEI

SEQ ID NO: 6806 - protein, 76 aa, Homo sapiens
MGSVSSLISGHSFHSKHCRASQYKLRKSSHLKKLNRYSDGLLRFGFSQDSGHGKAMTRCPRASSMSGSCGRRRRRR

SEQ ID NO: 6807 - protein, 573 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQRKKNEAELLREKVNLLEQELQELRAQAALARDMGPPTFPEDVPALQRELERLVWKEEKEKVIQYQKQLQQSYVAMYQRNQRLEKALQQLARGDSAGEPLEVDLEGADIPYEDIIATEI

SEQ ID NO: 6808 - protein, 596 aa, Homo sapiens; identical to SEQ ID NO: 6805

SEQ ID NO: 6809 - protein, 537 aa, Homo sapiens
MGSVSSLISGHSFHSKHCRASQYKLRKSSHLKKLNRYSDGLLRFGFSQDSGHGKSSSKMGKSEDFFYIKVSQKARGSHHPDYTALSSGDLGGQAGVDFDPSTPPKLMPFSNQLEMGSEKGAVRPTAFKPVLPRSGAILHSSPESASHQLHPAPPDKPKEQELKPGLCSGALSDSGRNSMSSLPTHSTSSSYQLDPLVTPVGPTSRFGGSAHNITQGIVLQDSNMMSLKALSFSDGGSKLGHSNKADKGPSCVRSPISTDECSIQELEQKLLEREGALQKLQRSFEEKELASSLAYEERPRRCRDELEGPEPKGGNKLKQASQKSQRAQQVLHLQVLQLQQEKRQLRQELESLMKEQDLLETKLRSYEREKTSFGPALEETQWEVCQKSGEISLLKQQLKESQTEVNAKASEILGLKAQLKDTRGKLEGLELRTQDLEGALRTKGLELEVCENELQRKKNEAELLREKHERLVWKEEKEKVIQYQKQLQQSYVAMYQRNQRLEKALQQLARGDSAGEPLEVDLEGADIPYEDIIATEI

SEQ ID NO: 6810 - protein, 334 aa, Homo sapiens
MTENSDKVPIALVGPDDVEFCSPPAYATLTVKPSSPARLLKVGAVVLISGAVLLLFGAIGAFYFWKGSDSHIYNVHYTMSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPKEIQRERREVVRKIVPTTTKRPHSGPRSNPGAGRLNNETRPSVQEDSQAFNPDNPYHQQEGESMTFDPRLDHEGICCIECRRSYTHCQKICEPLGGYYPWPYNYQGCRSACRVIMPCSWWVARILGMV

SEQ ID NO: 6811 - protein, 129 aa, Homo sapiens
MSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPK

SEQ ID NO: 6812 - protein, 333 aa, Homo sapiens
MTENSDKVPIALVGPDDVEFCSPPAYATLTVKPSSPARLLKVGAVVLISGAVLLLFGAIGAFYFWKGSDSHIYNVHYTMSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPKEIQRERREVVRKIVPTTTKRPHSGPRSNPGAGRLNNETRPSVQEDSQAFNPDNPYHQEGESMTFDPRLDHEGICCIECRRSYTHCQKICEPLGGYYPWPYNYQGCRSACRVIMPCSWWVARILGMV

SEQ ID NO: 6813 - protein, 135 aa, Homo sapiens
MNEVIIYNVLLLRTISCISETYGHYLIHCPSKISPELLKKESITNSYAHFQIYNVHYTMSINGKLQDGSMEIDAGNNLETFKMGSGAEEAIAVNDFQNVSIFHAFREFNQASLRDFSNSRRSSVSHTHPNGNCSL

SEQ ID NO: 6814 - protein, 919 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 6815 - protein, 888 aa, Homo sapiens
MQRSIMAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 6816 - protein, 851 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTEAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 6817 - protein, 415 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRERRETRSHNCHPRHPHPRSPLKVGSWSPSGLRQPRKATWGWWPRTAAAPRGSCCHHLRSLPPGSSASSATSPGSLAVLPQPRR

SEQ ID NO: 6818 - protein, 832 aa, Homo sapiens
VCCPGSGARDQRKARLTDEEKCWTGRENSDANMQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKVLGNWG

SEQ ID NO: 6819 - protein, 949 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKRRPASEQRGRTVPAGRR

SEQ ID NO: 6820 - protein, 1009 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 6821 - protein, 911 aa, Homo sapiens
MAASQTSQTVASHVPFADLCSTLERIQKSKGRAEKIRHFREFLDSWRKFHDALHKNHKDVTDSFYPAMRLILPQLERERMAYGIKETMLAKLYIELLNLPRDGKDALKLLNYRTPTGTHGDAGDFAMIAYFVLKPRCLQKGSLTIQQVNDLLDSIASNNSAKRKDLIKKSLLQLITQSSALEQKWLIRMIIKDLKLGVSQQTIFSVFHNDAAELHNVTTDLEKVCRQLHDPSVGLSDISITLFSAFKPMLAAIADIEHIEKDMKHQSFYIETKLDGERMQMHKDGDVYKYFSRNGYNYTDQFGASPTEGSLTPFIHNAFKADIQICILDGEMMAYNPNTQTFMQKGTKFDIKRMVEDSDLQTCYCVFDVLMVNNKKLGHETLRKRYEILSSIFTPIPGRIEIVQKTQAHTKNEVIDALNEAIDKREEGIMVKQPLSIYKPDKRGEGWLKIKPEYVSGLMDELDILIVGGYWGKGSRGGMMSHFLCAVAEKPPPGEKPSVFHTLSRVGSGCTMKELYDLGLKLAKYWKPFHRKAPPSSILCGTEKPEVYIEPCNSVIVQIKAAEIVPSDMYKTGCTLRFPRIEKIRDDKEWHECMTLDDLEQLRGKASGKLASKHLYIGGDDEPQEKKRKAAPKMKKVIGIIEHLKAPNLTNVNKISNIFEDVEFCVMSGTDSQPKPDLENRIAEFGGYIVQNPGPDTYCVIAGSENIRVKNIILSNKHDVVKPAWLLECFKTKSFVPWQPRFMIHMCPSTKEHFAREYDCYGDSYFIDTDLNQLKEVFSGIKNSNEQTPEEMASLIADLEYRYSWDCSPLSMFRRHTVYLDSYAVINDLSTKNEGTRLAIKALELRFHGAKVVSCLAEGVSHVIIGEDHSRVADFKAFRRTFKRKFKILKESWVTDSIDKCELQEENQYLI

SEQ ID NO: 6822 - protein, 911 aa, Homo sapiens; identical to SEQ ID NO: 6821

SEQ ID NO: 6823 - protein, 911 aa, Homo sapiens; identical to SEQ ID NO: 6821

SEQ ID NO: 6824 - protein, 647 aa, Homo sapiens
MRLTLLCCTWREERMGEEGSELPVCASCGQRIYDGQYLQALNADWHADCFRCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 6825 - protein, 647 aa, Homo sapiens; identical to SEQ ID NO: 6824

SEQ ID NO: 6826 - protein, 613 aa, Homo sapiens
MLLASAPRRRRFLQRAKCCDCSASLSHQYYEKDGQLFCKKDYWARYGESCHGCSEQITKGLVMVAGELKYHPECFICLTCGTFIGDGDTYTLVEHSKLYCGHCYYQTVVTPVIEQILPDSPGSHLPHTVTLVSIPASSHGKRGLSVSIDPPHGPPGCGTEHSHTVRVQGVDPGCMSPDVKNSIHVGDRILEINGTPIRNVPLDEIDLLIQETSRLLQLTLEHDPHDTLGHGLGPETSPLSSPAYTPSGEAGSSARQKPVLRSCSIDRSPGAGSLGSPASQRKDLGRSESLRVVCRPHRIFRPSDLIHGEVLGKGCFGQAIKVTHRETGEVMVMKELIRFDEETQRTFLKEVKVMRCLEHPNVLKFIGVLYKDKRLNFITEYIKGGTLRGIIKSMDSQYPWSQRVSFAKDIASGMAYLHSMNIIHRDLNSHNCLVRENKNVVVADFGLARLMVDEKTQPEGLRSLKKPDRKKRYTVVGNPYWMAPEMINGRSYDEKVDVFSFGIVLCEIIGRVNADPDYLPRTMDFGLNVRGFLDRYCPPNCPPSFFPITVRCCDLDPEKRPSFVKLEHWLETLRMHLAGHLPLGPQLEQLDRGFWETYRRGESGLPAHPEVPD

SEQ ID NO: 6827 - protein, 156 aa, Homo sapiens
MMVLDKEDGVPMLSVQPKGKQKGCAGCNRKIKDRYLLKALDKYWHEDCLKCACCDCRLGEVGSTLYTKANLILCRRDYLRLFGTTGNCAACSKLIPAFEMVMRARDNVYHLDCFACQLCNQRFCVGDKFFLKNNMILCQMDYEEGQLNGTFESQVQ

SEQ ID NO: 6828 - protein, 155 aa, Homo sapiens
MVLDQEDGVPMLSVQPKGKQKGCAGCNRKIKDRYLLKALDKYWHEDCLKCACCDCRLGEVGSTLYTKANLILCRRDYLRLFGTTGNCAACSKLIPAFEMVMRARDNVYHLDCFACQLCNQRFCVGDKFFLKNNMILCQMDYEEGQLNGTFESQVQ

SEQ ID NO: 6829 - protein, 227 aa, Homo sapiens
MEGSAVTVLERGGASSPAERRSKRRRRSGGDGGGGGGARAPEGVRAPAAGQPRATKGAPPPPGTPPPSPMSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 6830 - protein, 158 aa, Homo sapiens
MSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 6831 - protein, 558 aa, Homo sapiens
MHRGGQPLKKRRGSFKMAELDQLPDESSSAKALVSLKEGSLSNTWNEKYSSLQKTPVWKGRNTSSAVEMPFRNSKRSRLFSDEDDRQINTRSPKRNQRVAMVPQKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMIKKEHIKKLREMNTEAEKLKSYSMPISIEFQRRYATIVLELEQLNKDLNKVLHKVQQYCYELAPDQGLQPADQPTDMRRRCEEEAQEIVRHANSSTGQPCVENENLTDLISRLTAILLQIKCLAEGGDLNSFEFKSLTDSLNDIKSTIDASNISCFQNNVEIHVAHIQSGLSQMGNLHAFAANNTNRD

SEQ ID NO: 6832 - protein, 507 aa, Homo sapiens
MAELDQLPDESSSAKALVSLKEGSLSNTWNEKYSSLQKTPVWKGRNTSSAVEMKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMIKKEHIKKLREMNTEAEKLKSYSMPISIEFQRRYATIVLELEQLNKDLNKVLHKVQQYCYELAPDQGLQPADQPTDMRRRCEEEAQEIVRHANSSTGQPCVENENLTDLISRLTAILLQIKCLAEGGDLNSFEFKSLTDSLNDIKSTIDASNISCFQNNVEIHVAHIQSGLSQMGNLHAFAANNTNRD

SEQ ID NO: 6833 - protein, 523 aa, Homo sapiens
MRPRTEGFFPPAGASLPFSTRNKQPAVPAAAARAAEHAPGAGPGRDSGAGTAPPALRRRASPCGLLPPFLPPGSAGGGGGGARRGPPSAAPPPRAGAGGAGPASASRGGSSAARRRGQRAPHSNLPRKDSLRPTMHRGGQPLKKRRGSFKMAELDQLPDESSSAKALVSLKEGSLSNTWNEKYSSLQKTPVWKGRNTSSAVEMPFRNSKRSRLFSDEDDRQINTRSPKRNQRVAMVPQKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMIKGTYQEIKGNEHRSRKIG

SEQ ID NO: 6834 - protein, 613 aa, Homo sapiens
ETAEQNSSLAVGLNDQLHDLSRSRSPAARSSASNIRERRARIARGRWDRVPDVATRRGLLRPAVSGKVRGRRRPSNVGFGNCSSAKALVSLKEGSLSNTWNEKYSSLQKTPVWKGRNTSSAVEMPFRNSKRSRLFSDEDDRQINTRSPKRNQRVAMVPQKFTATMSTPDKKASQKIGFRLRNLLKLPKAHKWCIYEWFYSNIDKPLFEGDNDFCVCLKESFPNLKTRKLTRVEWGKIRRLMGKPRRCSSAFFEEERSALKQKRQKIRLLQQRKVADVSQFKDLPDEIPLPLVIGTKVTARLRGVHDGLFTGQIDAVDTLNATYRVTFDRTGLGTHTIPDYEVLSNEPHETMPIAAFGQKQRPSRFFMTPPRLHYTPPLQSPIIDNDPLLGQSPWRSKISGSDTETLGGFPVEFLIQVTRLSKILMIKKEHIKKLREMNTEAEKLKSYSMPISIEFQRRYATIVLELEQLNKDLNKVLHKVQQYCYELAPDQGLQPADQPTDMRRRCEEEAQEIVRHANSSTGQPCVENENLTDLISRLTAILLQIKCLAEGGDLNSFEFKSLTDSLNDIKSTIDASNISCFQNNVEIHVAHIQSGLSQMGNLHAFAANNTNRD

SEQ ID NO: 6835 - protein, 4599 aa, Homo sapiens
MSEFLLALLTLSGLLPIARVLTVGADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKARYIGGGPSAFKLPHTAPPIYLNSDLKGPLTAGPTNYSNPVYAKLYMDGQNCRNSLGSVDERKELLPKKIEIGIRETVA

SEQ ID NO: 6836 - protein, 782 aa, Homo sapiens [sequence omitted]

SEQ ID NO: 6837 - protein, 4537 aa, Homo sapiens
FLHSGPEEVEIKCPLNHIACLGTNKCVHLSQLCNGVLDCPDGYDEGVHCQGESICQQLNCTMYKYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKARYIGGGPSAFKLPHTAPPIYLNSDLKGPLTAGPTNYSNPVYAKLYMDGQNCRNSLGSVDERKELLPKKIEIGIRETVA

SEQ ID NO: 6838 - protein, 280 aa, Homo sapiens
MCPPQAQAEVGPTMTEKAEMVCAPSPAPAPPPKPASPGPPQVEEVGHRGGSSPPRLPPGVPVISLGHSRPPGVAMPTTELGTLRPPLLQLSTLGTAPPTLALHYHPHPFLNSVYIGPAGPFSIFPSSRLKRRPSHCELDLAEGHQPQKVARRVFTNSRERWRQQNVNGAFAELRKLLPTHPPDRKLSKNEVLRLAMKYIGFLVRLLRDQAAALAAGPTPPGPRKRPVHRVPDDGARRGSGRRAEAAARSQPAPPADPDGSPGGAARPIKMEQTALSPEVR

SEQ ID NO: 6839 - protein, 539 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENDTLLDSQLEEKGLGASPWGNLGQQLLLLPTGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 6840 - protein, 509 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 6841 - protein, 516 aa, Homo sapiens
MGCGCSSHPEDDWMENIDVCENCHYPIVPLDGKGTLLIRNGSEVRDPLVTYEGSNPPASPLQGDPRQQGLKDKACGSLAVGFHLSPTYFLPGLAFLVPHPVTPGFLPIPARFSLMPLVFTDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTRYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 6842 - protein, 249 aa, Homo sapiens
MGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 6843 - protein, 536 aa, Homo sapiens
MGIPGSHNLRYFWNFPGQGPIISDVGGADLGGAPSAPSSIPSGTMGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTHGRIPYPGMTNPEVIQNLERGYRMVRPDNCPEELYQLMRLCWKERPEDRPTFDYLRSVLEDFFTATEGQYQPQP

SEQ ID NO: 6844 - protein, 399 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWQGQPVYPITGGFRQPYPSSLSVDTSMSRFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 6845 - protein, 386 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGGKRSSFPTCKAKAATPGPLLEMEAC

SEQ ID NO: 6846 - protein, 371 aa, Homo sapiens
MPQLSGGGGGGGGDPELCATDEMIPFKDEGDPQKEKIFAEISHPEEEGDLADIKSSLVNESEIIPASNGHEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 6847 - protein, 303 aa, Homo sapiens
MAEVARQAQTSQEPYHDKAREHPDDGKHPDGGLYNKGPSYSSYSGYIMMPNMNNDPYMSNGSLSPPIPRTSNKVPVVQPSHAVHPLTPLITYSDEHFSPGSHPSHIPSDVNSKQGMSRHPPAPDIPTFYPLSPGGVGQITPPLGWFSHHMIPGPPGPHTTGIPHPAIVTPQVKQEHPHTDSDLMHVKPQHEQRKEQEPKRPHIKKPLNAFMLYMKEMRANVVAECTLKESAAINQILGRRWHALSREEQAKYYELARKERQLHMQLYPGWSARDNYGKKKKRKREKLQESASGTGPRMTAAYI

SEQ ID NO: 6848 - protein, 499 aa, Homo sapiens
MNDDPSMEENGVERVCPESLLQSREYSSLPLPRHTSSTDGTITSSDPGLEILNMASCDLDRNSLCKKEEDTRSASPTIEAQGTSPAHDNIAFQDSTSKDKTILNLEAKEEPETIEEHKKEHASGDSVVSPLPVTTVKSVNLRQSENTSANEKEVEAEFLRLSLGFKCDWFTLEKRVKLEERSRDLAEENLKKEITNCLKLLESLTPLCEDDNQAQEIIKKLEKSIKFLSQCAARVASRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSSWRILGSKQSEHRPSLPRFISTYSWADAEEEKCELKTKDDSEPSGEETVERTRKPSLSEKKNNPSKWDVSSVYDTIASWATNLKSSIRKANKALWLSIAFIVLFAALMSFLTGQLFQKSVDAAPTQQEDSWTSLEHILWPFTRLRHNGPPPV

SEQ ID NO: 6849 - protein, 499 aa, Homo sapiens; identical to SEQ ID NO: 6848

SEQ ID NO: 6850 - protein, 499 aa, Homo sapiens; identical to SEQ ID NO: 6848

SEQ ID NO: 6851 - protein, 77 aa, Homo sapiens
MNDDPSMEENGVERVCPESLLQSREYSSLPLPRHTSSTDGTITSSDPGLEILNMASCDLDRNSLCKKEEDTRSASPT

SEQ ID NO: 6852 - protein, 8 aa, Homo sapiens
MNDDPSME

SEQ ID NO: 6853 - protein, 205 aa, Homo sapiens
MTPPERLFLPRVRGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 6854 - protein, 205 aa, Homo sapiens; identical to SEQ ID NO: 6853

SEQ ID NO: 6855 - protein, 138 aa, Homo sapiens
MTPPERLFLPRVRGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQGSSPPLLWPFQQLKSSLIKSPELSKK

SEQ ID NO: 6856 - protein, 435 aa, Homo sapiens
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 6857 - protein, 328 aa, Homo sapiens
MGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 6858 - protein, 574 aa, Homo sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 6859 - protein, 436 aa, Homo sapiens
MARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 6860 - protein, 211 aa, Homo sapiens
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 6861 - protein, 105 aa, Homo sapiens
MTTLTRQDLNFGQVVADVLCEFLEVAVHLILYVREVYPVGIFQKRKKYNVPVQMSCHPELNQYIQDTLHCVKPLLEKVRVHWAPQPSHPMLTPVPVCSQSNSGMG

SEQ ID NO: 6862 - protein, 176 aa, Homo sapiens
MTTLTRQDLNFGQVVADVLCEFLEVAVHLILYVREVYPVGIFQKRKKYNVPVQNDVEKVVVVILDKEHRPVEKFVFEITQPPLLSISSDSLLSHVEQLLRAFILKISVCDAVLDHNPPGVSTPHPLFPWHFHGYLGLVCVPRSMFGCSETHLFLTLRVHLLWEASLIDSTWLPSPY

SEQ ID NO: 6863 - protein, 211 aa, Homo sapiens; identical to SEQ ID NO: 6860

SEQ ID NO: 6864 - protein, 224 aa, Homo sapiens
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSIRWAAPAPRPLAGISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 6865 - protein, 224 aa, Homo sapiens; identical to SEQ ID NO: 6864

SEQ ID NO: 6866 - protein, 211 aa, Homo sapiens; identical to SEQ ID NO: 6860

SEQ ID NO: 6867 - protein, 198 aa, Homo sapiens [sequence omitted]

SEQ ID NO: 6868 - protein, 167 aa, Homo sapiens
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIK

SEQ ID NO: 6869 - protein, 1052 aa, Homo sapiens
MAGMDSGNLKTARLWRDAALRARKLRSNLRQLTLTAAGACPGAGADALESPASPQLVLPANLGDIEALNLGNNGLEEVPEGLGSALGSLRVLVLRRNRFARLPPAVAELGHHLTELDVSHNRLTALGAEVVSALRELRKLNLSHNQLPALPAQLGALAHLEELDVSFNRLAHLPDSLSCLSRLRTLDVDHNQLTAFPRQLLQLVALEELDVSSNRLRGLPEDISALRALKILWLSGAELGTLPAGFCELASLESLMLDNNGLQALPAQFSCLQRLKMLNLSSNLFEEFPAALLPLAGLEELYLSRNQLTSVPSLISGLGRLLTLWLDNNRIRYLPDSIVELTGLEELVLQGNQIAVLPDHFGQLSRVGLWKIKDNPLIQPPYEVCMKGIPYIAAYQKELAHSQPAVQPRLKLLLMGHKAAGKTLLRHCLTEERVEGCPGGGDKEKCYPPSPPPVSKGIEVTSWTADASRGLRFIVYDLAGDESYEVIQPFFLSPGALYVLVVNLATYEPRHFPTTVGSFLHRVGARVPHAVVCIVGTHADLCGERELEEKCLDIHRQIALQEKHDAEGLSRLAKVVDEALARDFELRSASPHAAYYGVSDKNLRRRKAHFQYLLNHRLQILSPVLPVSCRDPRHLRRLRDKLLSVAEHREIFPNLHRVLPRSWQVLEELHFQPPQAQRLWLSWWDSARLGLQAGLTEDRLQSALSYLHESGKLLYFEDSPALKEHVFHNLTRLIDILNVFFQRDPSLLLHKLLLGTSGEGKAEGESSPPMARSTPSQELLRATQLHQYVEGFLLHGLLPAHVIRLLLKPHVQAQQDLQLLLELLEKMGLCYCLNKPKGKPLNGSTAWYKFPCYVQNEVPHAEAWINGTNLAGQSFVAEQLQIEYSFPFTFPLGLFARYSVQINSHVVHRSDGKFQIFAYRGKVPVVVSYRPARGVLQPDTLSIASHASLPNIWTAWQAITPLVEELNVLLQEWPGLHYTVHILCSKCLKRGSPNPHAFPGELLSQPRPEGVAEIICPKNGSERVNVALVYPPTPTVISPCSKKNVGEKHRNQ

SEQ ID NO: 6870 - protein, 182 aa, Homo sapiens
MGKGRFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 6871 - protein, 181 aa, Homo sapiens
MFKKFDEKENVSNCIQLKTSVIKGIKNQLIEQFPGIEPWLNQIMPKKDPVKIVRCHEHIEILTVNGELLFFRQREGPFYPTLRLLHKYPFILPHQQVDKGAIKFVLSGANIMCPGLTSPGAKLYPAAVDTIVAIMAEGKQHALCVGVMKMSAEDIEKVNKGIGIENIHYLNDGLWHMKTYK

SEQ ID NO: 6872 - protein, 741 aa, Homo sapiens
MALFTPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVVNGTGTNSTNSTTAVPSLVALEKINVADIINGAQEKCVLPPMDGYPHCEGKIKWMKDMWRSDPCYADYGVDGSTCSFFIYLSEVENWCPHLPWRAKNPYEEADHNSLAEIRTDFNILYSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNQEEVEDAVKAILNQKIEPYMPYEFTCEGMLQRINAFIEKQDFCHGQVMWPPLSALQVKLAEPGQSCKQVCQESQLICEPSFFQHLNKDKDMLKYKVTCQSSELAKDILVPSFDPKNKHCVFQGDLLLFSCAGAHPRHQRVCPCRDFIKGQVALCKDCL

SEQ ID NO: 6873 - protein, 741 aa, Homo sapiens; identical to SEQ ID NO: 6872

SEQ ID NO: 6874 - protein, 469 aa, Homo sapiens
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 6875 - protein, 476 aa, Homo sapiens
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 6876 - protein, 488 aa, Homo sapiens
MAPAAWLRSAAARALLPPMLLLLLQPPPLLARALPPDAHHLHAERRGPQPWHAALPSSPAPAPATQEAPRPASSLRPPRCGVPDPSDGLSARNRQKRFVLSGGRWEKTDLTYRILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 6877 - protein, 471 aa, Homo sapiens
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNGYIYFFNGPIQFEYSIWSNRIVRVMPANSILWC

SEQ ID NO: 6878 - protein, 489 aa, Homo sapiens
MHPGVLAAFLFLSWTHCRALPLPSGGDEDDLSEEDLQFAERYLRSYYHPTNLAGILKENAASSMTERLREMQSFFGLEVTGKLDDNTLDVMKKPRCGVPDVGEYNVFPRTLKWSKMNLTYRIVNYTPDMTHSEVEKAFKKAFKVWSDVTPLNFTRLHDGIADIMISFGIKEHGDFYPFDGPSGLLAHAFPPGPNYGGDAHFDDDETWTSSSKGYNLFLVAAHEFGHSLGLDHSKDPGALMFPIYTYTGKSHFMLPDDDVQGIQSLYGPGDEDPNPKHPKTPDKCDPSLSLDAITSLRGETMIFKDRFFWRLHPQQVDAELFLTKSFWPELPNRIDAAYEHPSHDLIFIFRGRKFWALNGYDILEGYPKKISELGLPKEVKKISAAVHFEDTGKTLLFSGNQVWRYDDTNHIMDKDYPRLIEEDFPGIGDKVDAVYEKNESHSVTQAGVHCRNLSSLQPPPPGFKRFSCLSLWSSWDYRLYLFFQRTHTV

SEQ ID NO: 6879 - protein, 383 aa, Homo sapiens [sequence omitted]

SEQ ID NO: 6880 - protein, 582 aa, Homo sapiens
MSPAPRPPRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 6881 - protein, 660 aa, Homo sapiens
MEALMARGALTGPLRALCLLGCLLSHAAAAPSPIIKFPGDVAPKTDKELAVQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 6882 - protein, 610 aa, Homo sapiens
MQYLNTFYGCPKESCNLFVLKDTLKKMQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 6883 - protein, 584 aa, Homo sapiens
MQKFFGLPQTGDLDQNTIETMRKPRCGNPDVANYNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 6884 - protein, 477 aa, Homo sapiens
MKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 6885 - protein, 267 aa, Homo sapiens
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 6886 - protein, 707 aa, Homo sapiens
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 6887 - protein, 277 aa, Homo sapiens
MGGNSAGELCVFPFTFLGKEYSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPED

SEQ ID NO: 6888 - protein, 107 aa, Homo sapiens
MAGEDVGAPPDHLWVHQEGIYRDEYQRTWVAVVEEETSFLRARVQQIQVPLGDAARPSHLLTSQLPLMWQLYPEERYMDNNSRLWQIQHHLMVRGVQELLLKLLPDD

SEQ ID NO: 6889 - protein, 107 aa, Homo sapiens; identical to SEQ ID NO: 6888

SEQ ID NO: 6890 - protein, 442 aa, Homo sapiens
MVRSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6891 - protein, 436 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6892 - protein, 321 aa, Homo sapiens
MCNTNMSVPTDGAVTTSQIPASEQETLVRPKPLLLKLLKSVGAQKDTYTMKEDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6893 - protein, 452 aa, Homo sapiens
MVRSRQMCNTNMSVPTDGAVTTSQIPASEQETLVRPKPLLLKLLKSVGAQKDTYTMKEKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6894 - protein, 256 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLLLGVYQVTVYQAGESDTDSFEEDPEISLAHYL

SEQ ID NO: 6895 - protein, 265 aa, Homo sapiens
MSVPTDGAVTTSQIPASEQETLDLDAGVSEHSGDWLDQDSVSDQFSVEFEVESLDSEDYSLSEEGQELSDEDDEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6896 - protein, 466 aa, Homo sapiens
MCNTNMSVPTDGAVTTSQIPASEQETLVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6897 - protein, 321 aa, Homo sapiens; identical to SEQ ID NO: 6892

SEQ ID NO: 6898 - protein, 159 aa, Homo sapiens
MCNTNMSVPTDGAVTTSQIPASEQETLVRPKPLLLKLLKSVGAQKDTYTMKEDLDAGVSEHSGDWLDQDSVSDQFSVEFEVESLDSEDYSLSEEGQELSDEDDEVYQVTVYQAGESDTDSFEEDPEISLADYWKCLKKRNKPCPVCRQPIQMIVLTYFP

SEQ ID NO: 6899 - protein, 296 aa, Homo sapiens
MCNTNMSVPTDGAVTTSQIPASEQETLDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6900 - protein, 243 aa, Homo sapiens
MCNTNMSVPTDGAVTTSQIPASEQETLVRPKPLLLKLLKSVGAQKDTYTMKEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6901 - protein, 218 aa, Homo sapiens
MCNTNMSVPTDGAVTTSQIPASEQETLDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6902 - protein, 218 aa, Homo sapiens; identical to SEQ ID NO: 6901

SEQ ID NO: 6903 - protein, 256 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVYQVTVYQAGESDTDSFEEDPEISLADYW

SEQ ID NO: 6904 - protein, 270 aa, Homo sapiens
MCNTNMSVPTDGAVTTSQIPASEQETLDLDAGVSEHSGDWLDQDSVSDQFSVEFEVESLDSEDYSLSEEGQELSDEDDEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6905 - protein, 497 aa, Homo sapiens
MVRSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6906 - protein, 130 aa, Homo sapiens
MCNTNMSVPTDGAVTTSQIPASEQETLVRPKPLLLKLLKSVGAQKDTYTMKEFEREETQDKEESVESSLPLNAIEPCVICQGRPKNGCIVHGKTGHLMACFTCAKKLKKRNKPCPVCRQPIQMIVLTYFP

SEQ ID NO: 6907 - protein, 257 aa, Homo sapiens
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSE

SEQ ID NO: 6908 - protein, 296 aa, Homo sapiens; identical to SEQ ID NO: 6899

SEQ ID NO: 6909 - protein, 446 aa, Homo sapiens
MCNTNMSVPTDGAVTTSQIPASEQETLVRPKPLLLKLLKSVGAQKDTYTMKEKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 6910 - protein, 213 aa, Homo sapiens
MPNFVVDWRVYTDSLFLTVDFGLCAEESSTSRKRTTEDDIPTLPTSEHKCIHSREDEDLIENLAQDETSRLDLGFEEWDVAGLPWWFLGNLRSNYTPRSNGSTDLQTNQDVGTAIVSDTTDDLWFLNESVSEQLGVGIKVEAADTEQTSEEVGKVSDKKVIEVGKNDDLEDSKSLSDDTDVEVTSEDEWQCTECKKFNSPSKRYCFRCWALRK

SEQ ID NO: 6911 - protein, 131 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTEMGHLFCRISHALELAD

SEQ ID NO: 6912 - protein, 490 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTDAAQTLALAQDHSMDIPSQDQLKQSAEESSTSRKRTTEDDIPTLPTSEHKCIHSREDEDLIENLAQDETSRLDLGFEEWDVAGLPWWFLGNLRSNYTPRSNGSTDLQTNQDVGTAIVSDTTDDLWFLNESVSEQLGVGIKVEAADTEQTSEEVGKVSDKKVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 6913 - protein, 164 aa, Homo sapiens
MTSFSTSAQCSTSDSACRISPGQINQENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 6914 - protein, 140 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTAKCRGKFHFQKKNYRRRYPHTAYLRA

SEQ ID NO: 6915 - protein, 171 aa, Homo sapiens
DLIENLAQDETSRLDLGFEEWDVAGLPWWFLGNLRSNYTPRSNGSTDLQTNQVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVE

SEQ ID NO: 6916 - protein, 440 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTDAAQTLALAQDHSMDIPSQDQLKQSAEESSTSRKRTTEDDIPTLPTSEHKCIHSREDEDLIENLAQDETSRLDLGFEEWDVAGLPWWFLGNLRSNYTPRSNGSTDLQTNQVIEVGKNDDLEDSKSLSDDTDVEVTSEDEWQCTECKKFNSPSKRYCFRCWALRKDWYSDCSKLTHSLSTSDITAIPEKENEGNDVPDCRRTISAPVVRPKDAYIKKENSKLFDPCNSVEFLDLAHSSESQETISSMGEQLDNLSEQRTDTENMEDCQNLLKPCSLCEKRPRDGNIIHGRTGHLVTCFHCARRLKKAGASCPICKKEIQLVIKVFIA

SEQ ID NO: 6917 - protein, 127 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTGCQRRVNGPQRAW

SEQ ID NO: 6918 - protein, 153 aa, Homo sapiens
MTSFSTSAQCSTSDSACRISPGQINQVRPKLPLLKILHAAGAQGEMFTVKEVMHYLGQYIMVKQLYDQQEQHMVYCGGDLLGELLGRQSFSVKDPSPLYDMLRKNLVTLATATTGSQYGYSKSRPTEAKCRGKFHFQKKNYRRRYPHTAYLRA

SEQ ID NO: 6919 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 6920 - protein, 754 aa, Homo sapiens
MNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 6921 - protein, 161 aa, Homo sapiens
MLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVR

SEQ ID NO: 6922 - protein, 1728 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLAIAPLNMGTANSAQPRSLRSWRTWIRILDCKDTEDADLTPATYPKTSLVCGQQQKCLQDRPK

SEQ ID NO: 6923 - protein, 2089 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKEKDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 6924 - protein, 162 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRL

SEQ ID NO: 6925 - protein, 127 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLL

SEQ ID NO: 6926 - protein, 306 aa, Homo sapiens
  MOD_RES (1)..(1): Any amino acid
XHVGGTKDSEDNYGDSEDLDLQATQCFLENQGLEAVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVP

SEQ ID NO: 6927 - protein, 113 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSH

SEQ ID NO: 6928 - protein, 1802 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKEKDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 6929 - protein, 221 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILSSSLPPPQTSLLPLSLRLRLLGEEQIDPLSRLLKQLSPQPLSYRLPPPQTSLSPLSPHLGPLGEEKIGPLSRPLKQLCPQPLSSSLPPPQTNLSPLSPHLGPLGAGQIGPLSRPLNQLSL

SEQ ID NO: 6930 - protein, 245 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEA

SEQ ID NO: 6931 - protein, 244 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPHRGGLLSCQKRCHCRG

SEQ ID NO: 6932 - protein, 1825 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKEKDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 6933 - protein, 1655 aa, Homo sapiens
MYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKEKDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 6934 - protein, 646 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 6935 - protein, 527 aa, Homo sapiens
MVYIVRQFLLYNVSGSVYLDQLIVLLTAKFSILRIAGSRVHHSPFSGHLDGCSFLSLQHSLHTSLDMSRHENVFLGLTLSSKSAGLKGFQLAFVPGLLQGTGGYLDGPLPTPVDNPRVGLEVGLRLSLPPLPPCPGVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTGKPGLAREQGCARASFLPCPSPESPVQKGE

SEQ ID NO: 6936 - protein, 46 aa, Homo sapiens
GVVIVAVIVCILVLAVLGAVLYFLYKKGKLPCRRSGKQEMERNTSI

SEQ ID NO: 6937 - protein, 750 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMTLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 6938 - protein, 750 aa, Homo sapiens; identical to SEQ ID NO: 6937

SEQ ID NO: 6939 - protein, 750 aa, Homo sapiens; identical to SEQ ID NO: 6937

SEQ ID NO: 6940 - protein, 161 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLL

SEQ ID NO: 6941 - protein, 93 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLK

SEQ ID NO: 6942 - protein, 233 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYE

SEQ ID NO: 6943 - protein, 119 aa, Homo sapiens
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLK

SEQ ID NO: 6944 - protein, 750 aa, Homo sapiens; identical to SEQ ID NO: 6937

SEQ ID NO: 6945 - protein, 750 aa, Homo sapiens; identical to SEQ ID NO: 6937

SEQ ID NO: 6946 - protein, 15 aa, Homo sapiens
MGKSESQMDITDINT

SEQ ID NO: 6947 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 6948 - protein, 297 aa, Homo sapiens; identical to SEQ ID NO: 6947

SEQ ID NO: 6949 - protein, 7 aa, Homo sapiens
MTTPRNS

SEQ ID NO: 6950 - protein, 284 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 6951 - protein, 6 aa, Homo sapiens
MTTPRN

SEQ ID NO: 6952 - protein, 297 aa, Homo sapiens; identical to SEQ ID NO: 6947

SEQ ID NO: 6953 - protein, 309 aa, Homo sapiens
MDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGYLNHVRAASPQDLAGGYTSSLACHRALQDAFSGLFWQPS

SEQ ID NO: 6954 - protein, 267 aa, Homo sapiens
MDDQGCPRCKTTKYRNPSLKLMVNVCGHTLCESCVDLLFVRGAGNCPECGTPLRKSNFRVQLFEDPTVDKEVEIRKKVLKIYNKREEDFPSLREYNDFLEEVEEIVFNLTNNVDLDNTKKKMEIYQKENKDVIQKNKLKLTREQEELEEALEVERQENEQRRLFIQKEEQLQQILKRKNKQAFLDELGQHISLAPIHKLEEALYEYQPLQIETYGPHVPELEMLGRLGYLNHVRAASPQDLAGGYTSSLACHRALQDAFSGLFWQPS

SEQ ID NO: 6955 - protein, 169 aa, Homo sapiens
TREQEELEEALEVERQENEQRRLFIQKEEQLQQILKRKNKQAFLDELESSDLPVALLLAQHKDRSTQLEMQLEKPKPVKPVTFSTGIKMGQHISLAPIHKLEEALYEYQPLQIETYGPHVPELEMLGRLGYLNHVRAASPQDLAGGYTSSLACHRALQDAFSGLFWQPS

SEQ ID NO: 6956 - protein, 1320 aa, Homo sapiens
MFGLDQFEPQVNSRNAGQGERNFNETGLSMNTHFKAPAFHTGGPPGPVDPAMSALGEPPILGMNMEPYGFHARGHSELHAGGLQAQPVHGFFGGQQPHHGHPGSHHPHQHHPHFGGNFGGPDPGASCLHGGRLLGYGGAAGGLGSQPPFAEGYEHMAESQGPESFGPQRPGNLPDFHSSGASSHAVPAPCLPLDQSPNRAASFHGLPSSSGSDSHSLEPRRVTNQGAVDSLEYNYPGEAPSGHFDMFSPSDSEGQLPHYAAGRQVPGGAFPGASAMPRAAGMVGLSKMHAQPPQQQPQQQQQPQQQQQQHGVFFERFSGARKMPVGLEPSVGSRHPLMQPPQQAPPPPQQQPPQQPPQQQPPPPPGLLVRQNSCPPALPRPQQGEAGTPSGGLQDGGPMLPSQHAQFEYPIHRLENRSMHPYSEPVFSMQHPPPQQAPNQRLQHFDAPPYMNVAKRPRFDFPGSAGVDRCASWNGSMHNGALDNHLSPSAYPGLPGEFTPPVPDSFPSGPPLQHPAPDHQSLQQQQQQQQQQQQQQQQQQQQQQQQQQQQRQNAALMIKQMASRNQQQRLRQPNLAQLGHPGDVGQGGLVHGGPVGGLAQPNFEREGGSTGAGRLGTFEQQAPHLAQESAWFSGPHPPPGDLLPRRMGGSGLPADCGPHDPSLAPPPPPGGSGVLFRGPLQEPMRMPGEGHVPALPSPGLQFGGSLGGLGQLQSPGAGVGLPSAASERRPPPPDFATSALGGQPGFPFGAAGRQSTPHSGPGVNSPPSAGGGGGSSGGGGGGGAYPPQPDFQPSQRTSASKLGALSLGSFNKPSSKDNLFGQSCLAALSTACQNMIASLGAPNLNVTFNKKNPPEGKRKLSQNETDGAAVAGNPGSDYFPGGTAPGAPGPGGPSGTSSSGSKASGPPNPPAQGDGTSLSPNYTLESTSGNDGKPVSGGGGRGRGRRKRDSGHVSPGTFFDKYSAAPDSGGAPGVSPGQQQASGAAVGGSSAGETRGAPTPHEKALTSPSWGKGAELLLGDQPDLIGSLDGGAKSDSSSPNVGEFASDEVSTSYANEDEVSSSSDNPQALVKASRSPLVTGSPKLPPRGVGAGEHGPKAPPPALGLGIMSNSTSTPDSYGGGGGPGHPGTPGLEQVRTPTSSSGAPPPDEIHPLEILQAQIQLQRQQFSISEDQPLGLKGGKKGECAVGASGAQNGDSELGSCCSEAVKSAMSTIDLDSLMAEHSAAWYMPADKALVDSADDDKTLAPWEKAKPQNPNSKEAHDLPANKASASQPGSHLQCLSVHCTDDVGDAKARASVPTWRSLHSDISNRFGTFVAALT

SEQ ID NO: 6957 - protein, 1408 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISTWWKEPLNIVSFLFCFASGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 6958 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 6959 - protein, 764 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFIRHVNIALIQR

SEQ ID NO: 6960 - protein, 260 aa, Homo sapiens
MKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 6961 - protein, 582 aa, Homo sapiens
MAARSWQDELAQQAEEGSARLREMLSVGLGFLRTELGLDLGLEPKRYPGWVILVGTGALGLLLLFLLGYGWAAACAGARKKRRSPPRKREEAAAVPAAAPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 6962 - protein, 715 aa, Homo sapiens
MAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGLANHGQARHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 6963 - protein, 628 aa, Homo sapiens
MVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYTTQSYQWYSWGPPNMQCRLCASCWTYWKKYGGLKMPTRLDGERPGPNRSNMSPHGLPARSSGSPKFAMKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGTSSGLANHGQARHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 6964 - protein, 255 aa, Homo sapiens
MKTRQAFYLHTTKLTRIARRLCREILRPWHAARHPYLPINSAAIKAECTARLPEASQSPLVLKQAVRKPLEAVLRYLETHPRPPKPDPVKSVSSVLSSLTPAKVAPVINNGSPTILGKRSYEQHNGVDGNMKKRLLMPSRGTYLGLANHGQARHMGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 6965 - protein, 430 aa, Homo sapiens
MAANMYRVGDYVYFENSSSNPYLIRRIEELNKTANGNVEAKVVCFYRRRDISSTLIALADKHATLSVCYKAGPGADNGEEGEIEEEMENPEMVDLPEKLKHQLRHRELFLSRQLESLPATHIRGKCSVTLLNETESLKSYLEREDFFFYSLVYDPQQKTLLADKGEIRVGNRYQADITDLLKEGEEDGRDQSRLETQVWEAHNPLTDKQIDQFLVVARSVGTFARALDCSSSVRQPSLHMSAAAASRDITLFHAMDTLHKNIYDISKAISALVPQGGPVLCRDEMEEWSASEANLFEEALEKYGKDFTDIQQDFLPWKSLTSIIEYYYMWKTTDRYVQQKRLKAAEAESKLKQVYIPNYNKPNPNQISVNNVKAGVVNGTGAPGQSPGAGRACESCYMSSLRILLDILEEIWWLENANPVRWREARTKPQ

SEQ ID NO: 6966 - protein, 473 aa, Homo sapiens
MLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 6967 - protein, 730 aa, Homo sapiens
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQNSSSSASSEASETCQSVSECSSPTSVSSGSTMGAWVSTEKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 6968 - protein, 529 aa, Homo sapiens
MSRKSSVCSSLNSVNSSDSRSSGSHSHSPSSHYRYRSSNLAQQAPVRLSSVSSHDSGFISQDAFQSKSPSPMPPEAPNQNSSSSASSEASETCQSVSECSSPTSVSSGSTMGAWVSTEKLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 6969 - protein, 755 aa, Homo sapiens
MEAVIEKECSALGGLFQTIISDMKGSYPVWEDFINKAGKLQSQLRTTVVAAAAFLDAFQKVADMATNTRGGTREIGSALTRMCMRHRSIEAKLRQFSSALIDCLINPLQEQMEEWKKVANQLDKDHAKEYKKARQEIKKKSSDTLKLQKKAKKGRGDIQPQLDSALQDVNDKYLLLEETEKQAVRKALIEERGRFCTFISMLRPVIEEEISMLGEITHLQTISEDLKSLTMDPHKLPSSSEQVILDLKGSDYSWSYQTPPSSPSTTMSRKSSVCSSLNSVNSSDSRSSGSHSHSPSSHYRYRSSNLAQQAPVRLSSVSSHDSGFISQDAFQSKSPSPMPPEAPNQLSNGFSHYSLSSESHVGPTGAGLFPHCLPASRLLPRVTSVHLPDYAHYYTIGPGMFPSSQIPSWKDWAKPGPYDQPLVNTLQRRKEKREPDPNGGGPTTASGPPAAAEEAQRPRSMTVSAATRPGEEMEACEELALALSRGLQLDTQRSSRDSLQCSSGYSTQTTTPCCSEDTIPSQVSDYDYFSVSGDQEADQQEFDKSSTIPRNSDISQSYRRMFQAKRPASTAGLPTTLGPAMVTPGVATIRRTPSTKPSVRRGTIGAGPIPIKTPVIPVKTPTVPDLPGVLPAPPDGPEERGEHSPESPSVGEGPQGVTSMPSSMWSGQASVNPPLPGPKPSIPEEHRQAIPESEAEDQEREPPSATVSPGQIPESDPADLSPRDTPQGEDMLNAIRRGVKLKKTTTNDRSAPRFS

SEQ ID NO: 6970 - protein, 478 aa, Homo sapiens
MAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVKPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 6971 - protein, 580 aa, Homo sapiens
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTGEKIFQEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 6972 - protein, 262 aa, Homo sapiens
MGTTGLESLSLGDRGAAPTVTSSERLVPDPPNDLRKEDVAMELERVGEDEEQMMIKRSSECNPLLQEPIASAQFGATAGTECQDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 6973 - protein, 574 aa, Homo sapiens
MGTTGLESLSLGDRGAAPTVTSSERLVPDPPNDLRKEDVAMELERVGEDEEQMMIKRSSECNPLLQEPIASAQFGATAGTECRKSVPCGWERVVKQRLFGKTAGRFDVYFISPQGLKFRSKSSLANYLHKNGETSLKPEDFDFTVLSKRGIKSRYKDCSMAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVQSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTEDTIPRTQIERRKTSLYFSSKYNKEALSPPRRKAFKKWTPPRSPFNLVQETLFHDPWKLLIATIFLNRTSGKMAIPVLWKFLEKYPSAEVARTADWRDVSELLKPLGLYDLRAKTIVKFSDEYLTKQWKYPIELHGIGKYGNDSYRIFCVNEWKQVHPEDHKLNKYHDWLWENHEKLSLS

SEQ ID NO: 6974 - protein, 30 aa, Homo sapiens
MVNEARGNSSLNPCLEGSASSGSESSKDSS

SEQ ID NO: 6975 - protein, 697 aa, Homo sapiens
MDHRKARVLPAGHYCPSLGIWASQVGSVRSSVPPSISRNPAMVNEARGNSSLNPCLEGSASSGSESSKDSSRCSTPGLDPERHERLREKMRRRLESGDKWFSLEFFPPRTAEGAVNLISRFDRMAAGGPLYIDVTWHPAGDPGSDKETSSMMIASTAVNYCGLETILHMTCCRQRLEEITGHLHKAKQLGLKNIMALRGDPIGDQWEEEEGGFNYAVDLVKHIRSEFGDYFDICVAGYPKGHPEAGSFEADLKHLKEKVSAGADFIITQLFFEADTFFRFVKACTDMGITCPIVPGIFPIQGYHSLRQLVKLSKLEVPQEIKDVIEPIKDNDAAIRNYGIELAVSLCQELLASGLVPGLHFYTLNREMATTEVLKRLGMWTEDPRRPLPWALSAHPKRREEDVRPIFWASRPKSYIYRTQEWDEFPNGRWGNSSSPAFGELKDYYLFYLKSKSPKEELLKMWGEELTSEESVFEVFVLYLSGEPNRNGHKVTCLPWNDEPLAAETSLLKEELLRVNRQGILTINSQPNINGKPSSDPIVGWGPSGGYVFQKAYLEFFTSRETAEALLQVLKKYELRVNYHLVNVKGENITNAPELQPNAVTWGIFPGREIIQPTVVDPVSFMFWKDEAFALWIERWGKLYEEESPSRTIIQYIHDNYFLVNLVDNDFPLDNCLWQVVEDTLELLNRPTQNARETEAP

SEQ ID NO: 6976 - protein, 697 aa, Homo sapiens; identical to SEQ ID NO: 6975

SEQ ID NO: 6977 - protein, 656 aa, Homo sapiens [sequence omitted]

SEQ ID NO: 6978 - protein, 656 aa, Homo sapiens [sequence omitted]

SEQ ID NO: 6979 - protein, 30 aa, Homo sapiens; identical to SEQ ID NO: 6974

SEQ ID NO: 6980 - protein, 143 aa, Homo sapiens
MVNEARGNSSLNPCLEGSASSGSESSKDSSRCSTPGLDPERHERLREKMRRRLESGDKWFSLEFFPPRTAEGAVNLISRFDRMAAGGPLYIDVTWHPAGDPGSDKETSSMMIASTAVNYCGLETILHMTCCRQRLEEITGHLH

SEQ ID NO: 6981 - protein, 53 aa, Homo sapiens
MCRGCGCLPPDAPCPTLCSRNPAMVNEARGNSSLNPCLEGSASSGSESSKDSS

SEQ ID NO: 6982 - protein, 30 aa, Homo sapiens; identical to SEQ ID NO: 6974

SEQ ID NO: 6983 - protein, 835 aa, Homo sapiens
MAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSRHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPDQKQAAGMSQETFEEKYRLSPTLSSTKGHLLIHSRPRSSSVKRKRVSHGSHSPPKEKCKRKRSTRRSIMPRLQLCRSEDRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSVKNRPTRHDVLDDSCDGFKDLIKPHEELKKSGRGKKPTRTLVMTSMPSEKQNVVIQVVDKLKGFSIAPDVCETTTHVLSGKPLRTLNVLLGIARGCWVLSYDWVLWSLELGHWISEEPFELSHHFPAAPLCRSECHLSAGPYRGTLFADQPAMFVSPASSPPVAKLCELVHLCGGRVSQVPRQASIVIGPYSGKKKATVKYLSEKWVLDSITQHKVCAPENYLLSQ

SEQ ID NO: 6984 - protein, 610 aa, Homo sapiens
MAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLDDDVPILLFESNGSLIYTPTIEINSRHHSAMEKRLQEMKEKRENLSPTSSQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPDQKQAAGMSQETFEEKYRLSPTLSSTKGHLLIHSRPRSSSVKRKRVSHGSHSPPKEKCKRKRSTRRSIMPRLQLCRSEDRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSM

SEQ ID NO: 6985 - protein, 562 aa, Homo sapiens
MAAPILKDVVAYVEVWSSNGTENYSKTFTTQLVDMGAKVSKTFNKQVTHVIFKDGYQSTWDKAQKRGVKLVSVLWVEKCRTAGAHIDESLFPAANMNEHLSSLIKKKRKCMQPKDFNFKTPENDKRFQKKFEKMAKELQRQKTNLASQMIQQSHDNPSNSLCEAPLNISRDTLCSDEYFAGGLHSSFDDLCGNSGCGNQERKLEGSINDIKSDVCISSLVLKANNIHSSPSFTHLDKSSPQKFLSNLSKEEINLQRNIAGKVVTPDQKQAAGMSQETFEEKYRLSPTLSSTKGHLLIHSRPRSSSVKRKRVSHGSHSPPKEKCKRKRSTRRSIMPRLQLCRSEDRLQHVAGPALEALSCGESSYDDYFSPDNLKERYSENLPPESQLPSSPAQLSCRSLSKKERTSIFEMSDFSCVGKKTRTVDITNFTAKTISSPRKTGNGEGRATSSCVTSAPEEALRCCRQAGKEDACPEGNGFSYTIEDPALPKGHDDDLTPLEGSLEEMKEAVGLKSTQNKGTTSKISNSSEGEAQSEHEPCFIVDCNMETSTEEKENLPGGYSGSM

SEQ ID NO: 6986 - protein, 77 aa, Homo sapiens
MNVLLGSVVIFATFVTLCNASCYFIPNEGVPGDSTRMFLHLWVMTKTTAKESSRRRTASISWWRRRTQKRPVLSVNG

SEQ ID NO: 6987 - protein, 114 aa, Homo sapiens
MNVLLGSVVIFATFVTLCNASCYFIPNEGVPGDSTRKCMDLKGNKHPINSEWQTDNCETCTCYETEISCCTLVSTPVGYDKDNCQRIFKKEDCKYIVVEKKDPKKTCSVSEWII

SEQ ID NO: 6988 - protein, 1270 aa, Homo sapiens
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSGKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 6989 - protein, 436 aa, Homo sapiens
MLLSPKFSLSTIHIRLTAKGLLRNLRLPSGFRRSTVVFHTVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 6990 - protein, 517 aa, Homo sapiens
MTVPGGFRSCTETDISSKIFINSTLTPPAGSERHYDATLLTLLVVGSYSLCIIPLLATFTGKKTGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 6991 - protein, 770 aa, Homo sapiens
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSVLPKAAFS

SEQ ID NO: 6992 - protein, 1216 aa, Homo sapiens
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSAGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 6993 - protein, 342 aa, Homo sapiens
MGCPSSKLCLYSPCAATRREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 6994 - protein, 1216 aa, Homo sapiens; identical to SEQ ID NO: 6992

SEQ ID NO: 6995 - protein, 415 aa, Homo sapiens
MKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 6996 - protein, 2468 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPIKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 6997 - protein, 143 aa, Homo sapiens
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKAKKGKGKD

SEQ ID NO: 6998 - protein, 143 aa, Homo sapiens; identical to SEQ ID NO: 6997

SEQ ID NO: 6999 - protein, 143 aa, Homo sapiens; identical to SEQ ID NO: 6997

SEQ ID NO: 7000 - protein, 152 aa, Homo sapiens
MQHRGFLLLTLLALLALTSAVAKKKEEGALQCSVPGDHPRHQALHPQDQSKGQSQEREGKGLDAKPGCQGAPGVTWGLAHALPLPGPRCDPPVPSVCSLALINHALPCPSHSPAPPLSAQSGEGQGILGSLSLPQSNVSPRARFCSSPQFHY

SEQ ID NO: 7001 - protein, 143 aa, Homo sapiens; identical to SEQ ID NO: 6997

SEQ ID NO: 7002 - protein, 143 aa, Homo sapiens; identical to SEQ ID NO: 6997

SEQ ID NO: 7003 - protein, 143 aa, Homo sapiens; identical to SEQ ID NO: 6997

SEQ ID NO: 7004 - protein, 49 aa, Homo sapiens
MQHRGFLLLTLLALLALTSAVAKKKDKVKKGGPGSECAEWAWGPCTPSS

SEQ ID NO: 7005 - protein, 131 aa, Homo sapiens
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTK

SEQ ID NO: 7006 - protein, 87 aa, Homo sapiens
MQHRGFLLLTLLALLALTSAVAKKKADCKYKFENWGACDGGTGTKVRQGTLKKARYNAQCQETIRVTKPCTPKTKAKAKAKKGKGKD

SEQ ID NO: 7007 - protein, 904 aa, Homo sapiens
MAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDREAGRGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 7008 - protein, 808 aa, Homo sapiens
MAESSESFTMASSPAQRRRGNDPLTSSPGWGLGRMRRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 7009 - protein, 954 aa, Homo sapiens
MAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAGRGLLYDSDEEDEERPARKRRQVERATEDGEEDEEMIESIENLEDLKGHSVREWVSMAGPRLEIHHRFKNFLRTHVDSHGHNVFKERISDMCKENRESLVVNYEDLAAREHVLAYFLPEAPAELLQIFDEAALEVVLAMYPKYDRITNHIHVRISHLPLVEELRSLRQLHLNQLIRTSGVVTSCTGVLPQLSMVKYNCNKCNFVLGPFCQSQNQEVKPGSCPECQSAGPFEVNMEETIYQNYQRIRIQESPGKVAAGRLPRSKDAILLADLVDSCKPGDEIELTGIYHNNYDGSLNTANGFPVFATVILANHVAKKDNKVAVGELTDEDVKMITSLSKDQQIGEKESSRNASLAEAGIGAIPSQLLAIEPSLRRSGVPIGEVGVSQRQEARSFSSANTHWFLEDLLGPSCRDTMIFASIAPSIYGHEDIKRGLALALFGGEPKNPGGKHKVRGDINVLLCGDPGTAKSQFLKYIEKVSSRAIFTTGQGASAVGLTAYVQRHPVSREWTLEAGALVLADRGVCLIDEFDKMNDQDRTSIHEAMEQQSISISKAGIVTSLQARCTVIAAANPIGGRYDPSLTFSENVDLTEPIISRFDILCVVRDTVDPVQDEMLARFVVGSHVRHHPSNKEEEGLANGSAAEPAMPNTYGVEPLPQEVLKKYIIYAKERVHPKLNQMDQDKVAKMYSDLRKESMATGSIPITVRHIESMIRMAEAHARIHLRDYVIEDDVNMAIRVMLESFIDTQKFSVMRSMRKTFARYLSFRRDNNELLLFILKQLVAEQVTYQRNRFGAQQDTIEVPEKDLVDKARQINIHNLSAFYDSELFRMNKFSHDLKRKMILQQF

SEQ ID NO: 7010 - protein, 808 aa, Homo sapiens
MAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 7011 - protein, 330 aa, Homo sapiens
MHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRDGISPCCPGWSWTPGLKQSFYLSLPKGWDYRHKPLCLFDLILFNDCRVSMVEGIQGGPLGCVPGSSCAVNRHESPHRIHQPGQRRALLFS

SEQ ID NO: 7012 - protein, 762 aa, Homo sapiens
MWSCGRLREITWTSWTTRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 7013 - protein, 328 aa, Homo sapiens
RYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRDGISPCCPGWSWTPGLKQSFYLSLPKGWDYRHKPLCLFDLILFNDCRVSMVEGIQGGPLGCVPGSSCAVNRHESPHRIHQPGQRRALLFS

SEQ ID NO: 7014 - protein, 853 aa, Homo sapiens
MLPRSPPLPRGNLWWREEFGSFRAGVESSWEPPRDFGGGSSLAAGMAGTVVLDDVELREAQRDYLDFLDDEEDQGIYQSKVRELISDNQYRLIVNVNDLRRKNEKRANRLLNNAFEELVAFQRALKDFVASIDATYAKQYEEFYVGLEGSFGSKHVSPRTLTSCFLSCVVCVEGIVTKCSLVRPKVVRSVHYCPATKKTIERRYSDLTTLVAFPSSSVYPTKDEENNPLETEYGLSVYKDHQTITIQEMPEKAPAGQLPRSVDVILDDDLVDKAKPGDRVQVVGTYRCLPGKKGGYTSGTFRTVLIACNVKQMSKDAQPSFSAEDIAKIKKFSKTRSKDIFDQLAKSLAPSIHGHDYVKKAILCLLLGGVERDLENGSHIRGDINILLIGDPSVAKSQLLRYVLCTAPRAIPTTGRGSSGVGLTAAVTTDQETGERRLEAGAMVLADRGVVCIDEFDKMSDMDRTAIHEVMEQGRVTIAKAGIHARLNARCSVLAAANPVYGRYDQYKTPMENIGLQDSLLSRFDLLFIMLDQMDPEQDREISDHVLRMHRYRAPGEQDGDAMPLGSAVDILATDDPNFSQEDQQDTQIYEKHDNLLHGTKKKKEKMVSAAFMKKYIHVAKIIKPVLTQESATYIAEEYSRLRSQDSMSSDTARTSPVTARTLETLIRLATAHAKARMSKTVDLQDAEEAVELVQYAYFKKVLEKEKKRKKRSEDESETEDEEEKSQEDQEQKRKRRKTRQPDAKDGDSYDPYDFSDTEEEMPQVHTPKTADSQETKESQKVELSESRLKAFKVALLDVFREAHAQSIGMNRLTESINRDSEEPFSSVEIQAALSKMQDDNQVMVSEGIIFLI

SEQ ID NO: 7015 - protein, 863 aa, Homo sapiens
MSSPASTPSRRGSRRGRATPAQTPRSEDARSSPSQRRRGEDSTSTGELQPMPTSPGVDLQSPAAQDVLFSSPPQMHSSAIPLDFDVSSPLTYGTPSSRVEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLLLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 7016 - protein, 823 aa, Homo sapiens
MPGHLPLRDVEARIPPPRGSCSRCQPRLEWTCRALLRRTCCFPALPKCILQLSLLTLMLEGTPRSGVRGTPVRQRPDLGSAQKGLQVDLQSDGAAAEDIVASEQSLGQKLVIWGTDVNVAACKENFQRFLQRFIDPLAKEEENVGIDITEPLYMQRLGEINVIGEPFLNVNCEHIKSFDKNLYRQLISYPQEVIPTFDMAVNEIFFDRYPDSILEHQIQVRPFNALKTKNMRNLNPEDIDQLITISGMVIRTSQLIPEMQEAFFQCQVCAHTTRVEMDRGRIAEPSVCGRCHTTHSMALIHNRSLFSDKQMIKLQESPEDMPAGQTPHTVILFAHNDLVDKVQPGDRVNVTGIYRAVPIRVNPRVSNVKSVYKTHIDVIHYRKTDAKRLHGLDEEAEQKLFSEKRVELLKELSRKPDIYERLASALAPSIYEHEDIKKGILLQLFGGTRKDFSHTGRGKFRAEINILLCGDPGTSKSQLLQYVYNLVPRGQYTSGKGSSAVGLTAYVMKDPETRQLVLQTGALVLSDNGICCIDEFDKMNESTRSVLHEVMEQQTLSIAKAGIICQLNARTSVLAAANPIESQWNPKKTTIENIQLPHTLLSRFDLIFLLLDPQDEAYDRRLAHHLVALYYQSEEQAEEELLDMAVLKDYIAYAHSTIMPRLSEEASQALIEAYVDMRKIGSSRGMVSAYPRQLESLIRLAEAHAKVRLSNKVEAIDVEEAKRLHREALKQSATDPRTGIVDISILTTGMSATSRKRKEELAEALKKLILSKGKTPALKYQQLFEDIRGQSDIAITKDMFEEALRALADDDFLTVTGKTVRLL

SEQ ID NO: 7017 - protein, 863 aa, Homo sapiens; identical to SEQ ID NO: 7015

SEQ ID NO: 7018 - protein, 734 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 7019 - protein, 691 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQKYPEHAIHKVLQLMLRRGEIQHRMQRKVLYRLK

SEQ ID NO: 7020 - protein, 231 aa, Homo sapiens [sequence omitted]

SEQ ID NO: 7021 - protein, 374 aa, Homo sapiens
MNSSGITTWGSTGLRWRWRTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSGRSFAGAVSPQEEEEFRRLAALPNVYEVISKSIAPSIFGGTDMKKAIACLLFGGSRKRLPDGLTRRGDINLLMLGDPGTAKSQLLKFVEKCSPIGVYTSGKGSSAAGLTASVMRDPSSRNFIMEGGAMVLADGGVVCIDEFDKHREAAQAPLCHWLPGV

SEQ ID NO: 7022 - protein, 595 aa, Homo sapiens
MFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 7023 - protein, 717 aa, Homo sapiens
MFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPDGVLLLLPRMECNGAISAHHNLPLPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 7024 - protein, 643 aa, Homo sapiens
MSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPDGVLLLLPRMECNGAISAHHNLPLPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 7025 - protein, 732 aa, Homo sapiens
MFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPGYGVQYDYLDPRQITPSLETHLVQRLFFAGQINGTTGYEEAAAQTECCSVARLECSDMISQLQAILLPQPSLVAGTAGMHHNTQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 7026 - protein, 692 aa, Homo sapiens
MFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDGLCSRICDQSGVHYKVLNRRKGPAVWGLRAQIDRKLYKQNMQKEILNTPLLTVQEGAVEDLILTEPEPEHTGKCRVSGVVLVDGSTVYAESVILTTGTFLRGMIVIGLETHPAGRLGDQPSIGLAQTLEKLGFVVGRLKTGTPPRIAKESINFSILNKHIPDNPSIPFSFTNETVWIKPEDQLPCYLTHTNPRVDEIVLKNLHLNSHVKETTRGPRYCPSIESKVLRFPNRLHQVWLEPEGMDSDLIYPQGLSMTLPAELQEKMITCIRGLEKAKVIQPGYGVQYDYLDPRQITPSLETHLVQRLFFAGQINGTTGYEEAAAQGVIAGINASLRVSRKPPFVVSRTEGYIGVLIDDLTTLGTSEPYRMFTSRVEFRLSLRPDNADSRLTLRGYKDAGCVSQQRYERACWMKSSLEEGISVLKSIEFLSSKWKKLIPEASISTSRSLPVRALDVLKYEEVDMDSLAKAVPEPLKKYTKCRELAERLKIEATYESVLFHQLQEIKGVQQDEALQLPKDLDYLTIRDVSLSHEVREKLHFSRPQTIGAASRIPGVTPAAIINLLRFVKTTQRRQSAMNESSKTDQYLCDADRLQEREL

SEQ ID NO: 7027 - protein, 360 aa, Homo sapiens [sequence omitted]

SEQ ID NO: 7028 - protein, 360 aa, Homo sapiens [sequence omitted]

SEQ ID NO: 7029 - protein, 348 aa, Homo sapiens
MVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADSKALDLLDKMLTFNPHKRIEVEQALAHPYLEQYYDPSDEPIAEAPFKFDMELDDLPKEKLKELIFEETARFQPGYRS

SEQ ID NO: 7030 - protein, 316 aa, Homo sapiens
MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILALDLLDKMLTFNPHKRIEVEQALAHPYLEQYYDPSDEPIAEAPFKFDMELDDLPKEKLKELIFEETARFQPGYRS

SEQ ID NO: 7031 - protein, 364 aa, Homo sapiens
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 7032 - protein, 364 aa, Homo sapiens; identical to SEQ ID NO: 7031

SEQ ID NO: 7033 - protein, 213 aa, Homo sapiens
MGADLNNIVKCQALSDEHVQFLVYQLLRGLKYIHSAGIIHRDLKPSNVAVNEDCELRILDFGLARQADEEMTGYVATRWYRAPEIMLNWMHYNQTGAGGRPWGDEGQGPRLALDWLCMPGLRGQARSPRMWDPHSKVALQRPLEHDGCWPPLAVQLWTSPCLGGLGMAEEGVCPSWGLDVTVGLLEEGRGVGTLMEVPSPSHSGYLVRGLHHG

SEQ ID NO: 7034 - protein, 367 aa, Homo sapiens
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 7035 - protein, 357 aa, Homo sapiens
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 7036 - protein, 365 aa, Homo sapiens
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 7037 - protein, 152 aa, Homo sapiens
MQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTGQILHPVPATDPQEGFHSAVPTGQPPG

SEQ ID NO: 7038 - protein, 355 aa, Homo sapiens
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKL

SEQ ID NO: 7039 - protein, 257 aa, Homo sapiens
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTGQILHPVPATDPQEGFHSAVPTGQPPGCGPAGEDAGARRGQAPDGRAGPHPSLL

SEQ ID NO: 7040 - protein, 310 aa, Homo sapiens
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLLEKMLELDVDKRLTAAQALTHPFFEPFRDPEEETEAQQPFDDSLEHEKLTVDEWKQHIYKEIVNFSPIARKDSRRRSGMKL

SEQ ID NO: 7041 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 7042 - protein, 360 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRLTGTPPAYLINRMPSHEARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 7043 - protein, 307 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESLSTCWRRCLYWTQIRELQRPKPLHMPTLLSTTILMMNQWPILMISPLKAGTSL

SEQ ID NO: 7044 - protein, 283 aa, Homo sapiens
MKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 7045 - protein, 379 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 7046 - protein, 335 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILALDLLDRMLTFNPNKRITVEEALAHPYLEQYYDPTDEPVAEEPFTFAMELDDLPKERLKELIFQETARFQPGVLEAP

SEQ ID NO: 7047 - protein, 311 aa, Homo sapiens
MVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 7048 - protein, 335 aa, Homo sapiens; identical to SEQ ID NO: 7046

SEQ ID NO: 7049 - protein, 357 aa, Homo sapiens
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEVGQSPAAVGLGAGEQGGT

SEQ ID NO: 7050 - protein, 265 aa, Homo sapiens
MRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 7051 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 7052 - protein, 218 aa, Homo sapiens [sequence omitted]

SEQ ID NO: 7053 - protein, 427 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAVINGSQHPSSSSSVNDVSSMSTDPTLASDTDSSLEAAAGPLGCCR

SEQ ID NO: 7054 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMIKGGVLFPGTDHIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 7055 - protein, 384 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 7056 - protein, 427 aa, Homo sapiens; identical to SEQ ID NO: 7051

SEQ ID NO: 7057 - protein, 308 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENADSEHNKLKASQARDLLSKMLVIDASKRISVDEALQHPYINVWYDPSEAEAPPPKIPDKQLDEREHTIEEWKELIYKEVMDLEERTKNGVIRGQPSPLAQVQQ

SEQ ID NO: 7058 - protein, 142 aa, Homo sapiens
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHL

SEQ ID NO: 7059 - protein, 97 aa, Homo sapiens
MIIGLLNVFTPQKSLEEFQDVYIVMELMDANLCQVIQMELDHERMSYLLYQMLCGIKHLHSAGIIHRDLKPSNIVVKSDCTLKILDFGLARTAGTSF

SEQ ID NO: 7060 - protein, 142 aa, Homo sapiens; identical to SEQ ID NO: 7058

SEQ ID NO: 7061 - protein, 393 aa, Homo sapiens [sequence omitted]

SEQ ID NO: 7062 - protein, 400 aa, Homo sapiens [sequence omitted]

SEQ ID NO: 7063 - protein, 351 aa, Homo sapiens
MGVQGTLMSRDQTPHLLSILGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 7064 - protein, 347 aa, Homo sapiens
MESPASSQPASMPQSKGKSKRKKDLRISCMSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 7065 - protein, 318 aa, Homo sapiens
MSKPPAPNPTPPRNLDSRTFITIGDRNFEVEADDLVTISELGRGAYGVVEKVRHAQSGTIMAVKRIRATVNSQEQKRLLMDLDINMRTVDCFYTVTFYGALFREGDVWICMELMDTSLDKFYRKVLDKNMTIPEDILGEIAVSIVRALEHLHSKLSVIHRDVKPSNVLINKEGHVKMCDFGISGYLVDSVAKTMDAGCKPYMAPERINPELNQKGYNVKSDVWSLGITMIEMAILRFPYESWGTPFQQLKQVVEEPSPQLPADRFSPEFVDFTAQCLRKNPAERMSYLELMEHPFFTLHKTKKTDIAAFVKEILGEDS

SEQ ID NO: 7066 - protein, 370 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKGCLHDKNSDQATWLTRL

SEQ ID NO: 7067 - protein, 400 aa, Homo sapiens
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 7068 - protein, 382 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINQSMVVPQTPLHTARVLQEDKDHWDEVKEEMTSALATMRVDYDQVKIKDLKTSNNRLLNKRRKKQAGSSSASQGCNNQ

SEQ ID NO: 7069 - protein, 332 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINQSMVVPQTPLHTARVLQEDKDHWDEVK

SEQ ID NO: 7070 - protein, 382 aa, Homo sapiens; identical to SEQ ID NO: 7068

SEQ ID NO: 7071 - protein, 119 aa, Homo sapiens
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIME

SEQ ID NO: 7072 - protein, 473 aa, Homo sapiens
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 7073 - protein, 471 aa, Homo sapiens
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGENEDEKLNEVMQEAWKYNRECKLLRDTLQSFSWNGRGFTDKVDRLKLAEIVKQVIEEQTTSHESQ

SEQ ID NO: 7074 - protein, 471 aa, Homo sapiens [sequence omitted]

SEQ ID NO: 7075 - protein, 473 aa, Homo sapiens
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQATLALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 7076 - protein, 932 aa, Homo sapiens
MAAAAAVEAAAPMGALWGLVHDFVVGQQEGPADQVAADVKSGNYTVLQVVEALGSSLENPEPRTRARAIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRRESSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 7077 - protein, 363 aa, Homo sapiens
MLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCTAAPFLPPLLPSALQDSSTSTLQGSSWMNSYS

SEQ ID NO: 7078 - protein, 375 aa, Homo sapiens
MKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQVTDGSSGQRRLIALLMAFVCSLPRNGSSWMNSYS

SEQ ID NO: 7079 - protein, 375 aa, Homo sapiens; identical to SEQ ID NO: 7078

SEQ ID NO: 7080 - protein, 987 aa, Homo sapiens
MAAAAAVEAAAPMGALWGLVHDFVVGQQEGPADQVAADVKSGNYTVLQVVEALGSSLENPEPRTRARAIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 7081 - protein, 1030 aa, Homo sapiens
MAAAAAVEAAAPMGALWGLVHDFVVGQQEGPADQVAADVKSGNYTVLQVVEALGSSLENPEPRTRARAIQLLSQVLLHCHTLLLEKEVVHLILFYENRLKDHHLVIPSVLQGLKALSLCVALPPGLAVSVLKAIFQEVHVQSLPQVDRHTVYNIITNFMRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 7082 - protein, 1009 aa, Homo sapiens
MAAAAAVEAAAPMGALWGLVHDFVVGQQEGPADQVAASSLENPEPRTRARAIQLLSQVLLHCHTLLLEKEVVHLILFYENRLKDHHLVIPSVLQGLKALSLCVALPPGLAVSVLKAIFQEVHVQVDRHTVYNIITNFMRTREEELKSLGADFTFGFIQVMDGEKDPRNLLVAFRIVHDLISRDYSLGPFVEELFEVTSCYFPIDFTPPPNDPHGIQREDLILSLRAVLASTPRFAEFLLPLLIEKVDSEVLSAKLDSLQTLNACCAVYGQKELKDFLPSLWASIRREVFQTASERVEAEGLAALHSLTACLSRSVLRADAEDLLDSFLSNILQDCRHHLCEPDMKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQDGSSGQRRLIALLMAFVCSLPRNVEIPQLNQLMRELLELSCCHSCPFSSTAAAKCFAGLLNKHPAGQQLDEFLQLAVDKVEAGLGSGPCRSQAFTLLLWVTKALVLRYHPLSSCLTARLMGLLSDPELGPAAADGFSLLMSDCTDVLTRAGHAEVRIMFRQRFFTDNVPALVQGFHAAPQDVKPNYLKGLSHVLNRLPKPVLLPELPTLLSLLLEALSCPDCVVQLSTLSCLQPLLLEAPQVMSLHVDTLVTKFLNLSSSPSMAVRIAALQCMHALTRLPTPVLLPYKPQVIRALAKPLDDKKRLVRKEAVSARGEWFLLGSPGS

SEQ ID NO: 7083 - protein, 1030 aa, Homo sapiens; identical to SEQ ID NO: 7081

SEQ ID NO: 7084 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 7085 - protein, 238 aa, Homo sapiens
MRFKNRFQRFMNHRAPANGRYKPTCYEHAANCYTHAFLIVPAIVGSALLHRLSDDCWEKITAWIYGMGLCALFIVSTVFHIVSWKKSHLRTVEHCFHMCDRMVIYFFIAASYAPWLNLRELGPLASHMRWFIWLMAAGGTIYVFLYHEKYKVVELFFYLTMGFSPALVVTSMNNTDGLQELACGGLIYCLGVVFFKSDGIIPFAHAIWHLFVATAAAVHYYAIWKYLYRSPTDFMRHL

SEQ ID NO: 7086 - protein, 708 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 7087 - protein, 680 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 7088 - protein, 707 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRDTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 7089 - protein, 711 aa, Homo sapiens
MNRNISHQKGDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 7090 - protein, 127 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHG

SEQ ID NO: 7091 - protein, 111 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNY

SEQ ID NO: 7092 - protein, 221 aa, Homo sapiens
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRV

SEQ ID NO: 7093 - protein, 273 aa, Homo sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7094 - protein, 224 aa, Homo sapiens
MTPGTQSPFFLLLLLTVLTATTAPKPATVVTGSGHASSTPGGEKETSATQRSSVPSSTEKNAFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7095 - protein, 166 aa, Homo sapiens
MTPGTQSPFFLLLLLTVLTATTAPKPATVVTGSGHASSTPGGEKETSATQRSSVPSSTEKNASGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7096 - protein, 203 aa, Homo sapiens
MTPGTQSPFFLLLLLTVLTVVTGSGHASSTPGGEKETSATQRSSVPSSTEKNAIPAPTTTKSCRETFLKCFCRFINKGVFWASPILSSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7097 - protein, 168 aa, Homo sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 7098 - protein, 255 aa, Homo sapiens
MTPGTQSPFFLLLLLTVLTVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7099 - protein, 264 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7100 - protein, 198 aa, Homo sapiens
MTPGTQSPFFLLLLLTVLTVVTGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSGCLSVPPKELRAAGHLSSPGYLPSYERVPHLPHPWALCAP

SEQ ID NO: 7101 - protein, 475 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7102 - protein, 159 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMAVCQCRRKNYGQLDIFPARDTYHPMSEYPTYHTHGRYVPPSSTDRSPYEKVSAGNGGSSLSYTNPAVAATSANL

SEQ ID NO: 7103 - protein, 230 aa, Homo sapiens
MTPGTQSPFFLLLLLTVLTVVTGSGHASSTPGGEKETSATQRSSVPSSTEKNAIPAPTTTKSCRETFLKWPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7104 - protein, 561 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDTRPAPGSTAPPAHGVTSAPDTRPAPGSTAPPAHGVTSAPDTRPAPGSTAPPAHGVTSAPDTRPAPGSTAPPAHGVTSAPDTRRAPGSTPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7105 - protein, 229 aa, Homo sapiens
MTPGTQSPFFLLLLLTVLTVVTGSGHASSTPGGEKETSATQRSSVPSSTEKNAIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 7106 - protein, 259 aa, Homo sapiens
MTPGTQSPFFLLLLLTVLTATTAPKPATVVTGSGHASSTPGGEKETSATQRSSVPSSTEKNAFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKRQNGWSTMPRGALPEESQG

SEQ ID NO: 7107 - protein, 610 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPTASPPPEGPVLTFQSEKMKGMKELLVATKINSSAIKLQLTAQSQVQMKKQKVSTPSDYTLSFLKRQRKGL

SEQ ID NO: 7108 - protein, 610 aa, Homo sapiens; identical to SEQ ID NO: 7107

SEQ ID NO: 7109 - protein, 615 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGWSPVGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPTASPPPEGPVLTFQSEKMKGMKELLVATKINSSAIKLQLTAQSQVQMKKQKVSTPSDYTLSFLKRQRKGL

SEQ ID NO: 7110 - protein, 615 aa, Homo sapiens; identical to SEQ ID NO: 7109

SEQ ID NO: 7111 - protein, 555 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQVRQKVRIVSREAEAAEAEEPWGEEAREGRRRGPRRESKPEEPPPPKKPALDKGLGTGQGAVSGPPRKPPGTVAGTARGPEGGSTAQVPAPTASPPPEGPVLTFQSEKMKGMKELLVATKINSSAIKLQLTAQSQVQMKKQKVSTPSDYTLSFLKRQRKGL

SEQ ID NO: 7112 - protein, 575 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPTASPPPEGPVLTFQSEKMKGMKELLVATKINSSAIKLQLTAQSQVQMKKQKVSTPSDYTLSFLKRQRKGL

SEQ ID NO: 7113 - protein, 610 aa, Homo sapiens; identical to SEQ ID NO: 7107

SEQ ID NO: 7114 - protein, 615 aa, Homo sapiens; identical to SEQ ID NO: 7109

SEQ ID NO: 7115 - protein, 615 aa, Homo sapiens; identical to SEQ ID NO: 7109

SEQ ID NO: 7116 - protein, 261 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQ

SEQ ID NO: 7117 - protein, 146 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSF

SEQ ID NO: 7118 - protein, 146 aa, Homo sapiens; identical to SEQ ID NO: 7117

SEQ ID NO: 7119 - protein, 346 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTAT

SEQ ID NO: 7120 - protein, 615 aa, Homo sapiens; identical to SEQ ID NO: 7109

SEQ ID NO: 7121 - protein, 281 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALG

SEQ ID NO: 7122 - protein, 551 aa, Homo sapiens
MAAPVRLGRKRPLPACPNPLFVRWLTEWRDEATRSRRRTRFVFQKALRSLRRYPLPLRSGKEAKILQHFGDGLCRMLDERLQRHRTSGGDHAPDSPSGENSPAPQGRLAEVQDSSMPVPAQPKAGGSGSYWPARHSGARVILLVLYREHLNPNGHHFLTKEELLQRCAQKSPRVAPGSARPWPALRSLLHRNLVLRTHQPARYSLTPEGLELAQKLAESEGLSLLNVGIGPKEPPGEETAVPGAASAELASEAGVQQQPLELRPGEYRVLLCVDIGETRGGGHRPELLRELQRLHVTHTVRKLHVGDFVWVAQETNPRDPANPGELVLDHIVERKRLDDLCSSIIDGRFREQKFRLKRCGLERRVYLVEEHGSVHNLSLPESTLLQAVTNTQVIDGFFVKRTADIKESAAYLALLTRGLQRLYQGHTLRSRPWGTPGNPESGAMTSPNPLCSLLTFSDFNAGAIKNKAQSVREVFARQLMQVRGVSGEKAAALVDRYSTPASLLAAYDACATPKEQETLLSTIKCGRLQRNLGPALSRTLSQLYCSYGPLT

SEQ ID NO: 7123 - protein, 551 aa, Homo sapiens; identical to SEQ ID NO: 7122

SEQ ID NO: 7124 - protein, 829 aa, Homo sapiens
MNSGVAMKYGNDSSAELSELHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETQVRMLKQRIALLEEENSRPHTNETSL

SEQ ID NO: 7125 - protein, 756 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 7126 - protein, 551 aa, Homo sapiens
KPLLNHVLAIKGPRSRWRTFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDESEVPGSIPNSWKWTVEHIVYKALRSHILPPKHFTEDGNILQLANLPDLYKVFERC

SEQ ID NO: 7127 - protein, 116 aa, Homo sapiens
MSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLRVKCLAPFQTPGSGLWNT

SEQ ID NO: 7128 - protein, 174 aa, Homo sapiens [sequence omitted]

SEQ ID NO: 7129 - protein, 658 aa, Homo sapiens
MAFEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 7130 - protein, 319 aa, Homo sapiens
MIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQKETSGRF

SEQ ID NO: 7131 - protein, 515 aa, Homo sapiens
MNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 7132 - protein, 679 aa, Homo sapiens
  MOD_RES (1)..(1): Any amino acid
XRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDESEVPGSIPNSWKWTVEHIVYKALRSHILPPKHFTEDGNILQLANLPDLYKVFERC

SEQ ID NO: 7133 - protein, 515 aa, Homo sapiens; identical to SEQ ID NO: 7131

SEQ ID NO: 7134 - protein, 460 aa, Homo sapiens
MNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQ

SEQ ID NO: 7135 - protein, 280 aa, Homo sapiens
MIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLRLCYQDLLAPLGRWLNPQQV

SEQ ID NO: 7136 - protein, 515 aa, Homo sapiens; identical to SEQ ID NO: 7131

SEQ ID NO: 7137 - protein, 1429 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEADSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 7138 - protein, 1453 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEAGGNLLVLVDQHAAHERIRLEQLIIDSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 7139 - protein, 391 aa, Homo sapiens
MVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEAGGNLLVLVDQHAAHERIRLEQLIIDSYEKQQAQGSGRKKLLSSTLIPPLEITVTEEQRRLLWCYHKNLEDLGLEFVFPDTSDSLVLVGKVPLCFVEREANELRRGRSTVTKSIVELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 7140 - protein, 198 aa, Homo sapiens
MNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVLQQVDNKFIACLMSTKTEENGEAAELMMLQDPCCRQSREDENHEFSL

SEQ ID NO: 7141 - protein, 162 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCM

SEQ ID NO: 7142 - protein, 1453 aa, Homo sapiens; identical to SEQ ID NO: 7138

SEQ ID NO: 7143 - protein, 106 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASA

SEQ ID NO: 7144 - protein, 934 aa, Homo sapiens [sequence omitted]

SEQ ID NO: 7145 - protein, 341 aa, Homo sapiens [sequence omitted]

SEQ ID NO: 7146 - protein, 921 aa, Homo sapiens
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLERENLRVTEPKDQCLILLTWKRKLRGGKRSACSRPERQNQGSGELS

SEQ ID NO: 7147 - protein, 720 aa, Homo sapiens
MIGIWHIRLLLAISLSLKTFSLVTMICQLPLVLWVLKCPQLMARDMGKLRQIIQRGGILITERKKADFSTKDIYQDLNRLLKGKKGEQMNSAVLPEMENQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLEREQGEKIIQEFLSKVKQMPFTEMSEENITIKLKQLKAEVIAKNNSFVNEIISRIKVTT

SEQ ID NO: 7148 - protein, 810 aa, Homo sapiens
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATIFMNLLPWPIRYQLLIIYMSQHSPLKRP

SEQ ID NO: 7149 - protein, 168 aa, Homo sapiens
MDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGGSLQPRSSRLACAT

SEQ ID NO: 7150 - protein, 533 aa, Homo sapiens
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEKSPS

SEQ ID NO: 7151 - protein, 410 aa, Homo sapiens
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDYFVDSQILTDLPRSFKDKQQTYKIVTDSIRV

SEQ ID NO: 7152 - protein, 485 aa, Homo sapiens
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELRNNE

SEQ ID NO: 7153 - protein, 868 aa, Homo sapiens
MGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLEREQGEKIIQEFLSKVKQMPFTEMSEENITIKLKQLKAEVIAKNNSFVNEIISRIKVTT

SEQ ID NO: 7154 - protein, 1137 aa, Homo sapiens
MSRRKPASGGLAASSSAPARQAVLSRFFQSTGSLKSTSSSTGAADQVDPGAAAAAAAAAAAAPPAPPAPAFPPQLPPHIATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGQSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 7155 - protein, 1128 aa, Homo sapiens
MSRRKPASGGLAASSSAPARQAVLSRFFQSTGSLKSTSSSTGAADQVDPGAAAAAAPPAPAFPPQLPPHIATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGQSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 7156 - protein, 936 aa, Homo sapiens
MLRPEISSTSPSAPAVSPSSGETRSPQGPRYNFGLQETPQSRPSVQVVSASTCPGTSGAAGDRSSSSSSLPCPAPNSRPAQGSYFGNKRAYAENTVASNFTFGASSSSARDTNYPQTLKTPLSTGNPQRSGYKSWTPQVGYSASSSSAISAHSPSVIVAVVEGRGLARGEIGMASIDLKNPQIILSQFADNTTYAKVITKLKILSPLEIIMSNTACAVGNSTKLFTLITENFKNVNFTTIQRKYFNETKGLEYIEQLCIAEFSTVLMEVQSKYYCLAAVAALLKYVEFIQNSVYAPKSLKICFQGSEQTAMIDSSSAQNLELLINNQDYRNNHTLFGVLNYTKTPGGSRRLRSNILEPLVDIETINMRLDCVQELLQDEELFFGLQSVISRFLDTEQLLSVLVQIPKQDTVNAAESKITNLIYLKHTLELVDPLKIAMKNCNTPLLRAYYGSLEDKRFGIILEKIKTVINDDARYMKGCLNMRTQKCYAVRSNINEFLDIARRTYTEIVDDIAGMISQLGEKYSLPLRTSFSSARGFFIQMTTDCIALPSDQLPSEFIKISKVKNSYSFTSADLIKMNERCQESLREIYHMTYMIVCKLLSEIYEHIHCLYKLSDTVSMLDMLLSFAHACTLSDYVRPEFTDTLAIKQGWHPILEKISAEKPIANNTYVTEGSNFLIITGPNMSGKSTYLKQIALCQIMAQIGSYVPAEYSSFRIAKQIFTRISTDDDIETNSSTFMKEMKEIAYILHNANDKSLILIDELGRGTNTEEGIGICYAVCEYLLSLKAFTLFATHFLELCHIDALYPNVENMHFEVQHVKNTSRNKEAILYTYKLSKGLTEEKNYGLKAAEVSSLPPSIVLDAKEITTQITRQILQNQRSTPEMERQRAVYHLATRLVQTARNSQLDPDSLRIYLSNLKKKYKEDFPRTEQVPEKTEE

SEQ ID NO: 7157 - protein, 270 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLL

SEQ ID NO: 7158 - protein, 270 aa, Homo sapiens; identical to SEQ ID NO: 7157

SEQ ID NO: 7159 - protein, 194 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRR

SEQ ID NO: 7160 - protein, 270 aa, Homo sapiens; identical to SEQ ID NO: 7157

SEQ ID NO: 7161 - protein, 287 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTPPGDLRFTPIPLLIPSQVRALGGLLKFLGRRRIGVELEDYNVSVPILGFKKFMLTHLVNIDQDTYSVLQIFKSESHPSVYKVASGLKEGLSLFGILNRCHCKWGEKLL

SEQ ID NO: 7162 - protein, 107 aa, Homo sapiens
KILFLSSIIPFDCLLTVRALGGLLKFLGRRRIGVELEDYNVSVPILGFKKFMLTHLVNIDQDTYSVLQIFKSESHPSVYKVASGLKEGLSLFGILNRCHCKWGEKLL

SEQ ID NO: 7163 - protein, 254 aa, Homo sapiens
MASLGANPRRTPQGPRPGAASSGFPSPAPVPGPREAEEEEVEEEEELAEIHLCVLWNSGYLGIAYYDTSDSTIHFMPDAPDHESLKLLQRVLDEINPQSVVTSAKQDENMTRFLGKLASQEHREPKRPEIIFLPSVDFGLEISKQRLLSGNYSFIPDAMTATEKILFLSSIIPFDCLLTVRALGGLLKFLGRRRIGVELEDYNVSVPILGFKKFMLTHLVNIDQDTYRLECNGAISAQCNLCLLGSSDSPASAS

SEQ ID NO: 7164 - protein, 1360 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 7165 - protein, 252 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRKKR

SEQ ID NO: 7166 - protein, 1058 aa, Homo sapiens
MVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 7167 - protein, 1230 aa, Homo sapiens
MSRQSTLYSFFPKSPALSDANKASARASREGGRAAAAPGASPSPGGDAAWSEAGPGPRPLARSASPPKAKNLNGGLRRSVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 7168 - protein, 324 aa, Homo sapiens
MRRLFYNFDKNYKDWQSAVECIAVLDVLLCLANYSRGGDGPMCRPVILLPEDTPPFLELKGSRHPCITKTFFGDDFIPNDILIGCEEEEQENGKIVCLLLDQIWGASLRMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHISRRLFSKCCCLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 7169 - protein, 1066 aa, Homo sapiens
MSRQSTLYSFFPKSPALSDANKASARASREGGRAACPRGLSFPRRGCGLERGWAWRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLGKTLNKLVLRL

SEQ ID NO: 7170 - protein, 522 aa, Homo sapiens
MRKPRAAVGSGHRKQAASQEGRQKHAKNNSQAKPSACDAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 7171 - protein, 521 aa, Homo sapiens
MRKPRAAVGSGHRKQAASQEGRQKHAKNNSQAKPSACDGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 7172 - protein, 546 aa, Homo sapiens
MTPLVSRLSRLWAIMRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 7173 - protein, 532 aa, Homo sapiens
MRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 7174 - protein, 521 aa, Homo sapiens; identical to SEQ ID NO: 7171

SEQ ID NO: 7175 - protein, 536 aa, Homo sapiens
MTPLVSRLSRLWAIMRKPRAAVGSGHRKQAASQEGRQKHAKNNSQAKPSACDAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 7176 - protein, 535 aa, Homo sapiens
MTPLVSRLSRLWAIMRKPRAAVGSGHRKQAASQEGRQKHAKNNSQAKPSACDGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 7177 - protein, 291 aa, Homo sapiens
MRKPRAAVGSGHRKQAASQEGRQKHAKNNSQAKPSACDGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRA

SEQ ID NO: 7178 - protein, 532 aa, Homo sapiens; identical to SEQ ID NO: 7173

SEQ ID NO: 7179 - protein, 549 aa, Homo sapiens
MTPLVSRLSRLWAIMRKPRAAVGSGHRKQAASQEGRQKHAKNNSQAKPSACDACAGMIAECPGAPAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 7180 - protein, 521 aa, Homo sapiens; identical to SEQ ID NO: 7171

SEQ ID NO: 7181 - protein, 215 aa, Homo sapiens
MTPLVSRLSRLWEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREES

SEQ ID NO: 7182 - protein, 230 aa, Homo sapiens
MTPLVSRLSRLWAIMRKPRAAVGSGHRKQAASQEGRQKHAKNNSQAKPSACDGGESTLGWPGLLFSWPAAAGGSSEGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 7183 - protein, 96 aa, Homo sapiens
MSDNDDIEVESDEEQPRFQSAADKRAHHNALERKRRDHIKDSFHSLRDSVPSLQGEKLYFLFWKLCTPVLHRQSLMQKCHTFISSYQVHKKKECKI

SEQ ID NO: 7184 - protein, 134 aa, Homo sapiens
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQGEHPSSWGSWPCCAPARSGFGTWACRVRASHGVCAQ

SEQ ID NO: 7185 - protein, 83 aa, Homo sapiens
MSDNDDIEVESDEEQPRFQSAADKRAHHNALERKRRDHIKDSFHSLRDSVPSLQGEKGTKMKLTLPPVFPYEHLPFPTVFCHG

SEQ ID NO: 7186 - protein, 151 aa, Homo sapiens
MSDNDDIEVESDADKRAHHNALERKRRDHIKDSFHSLRDSVPSLQGEKASRAQILDKATEYIQYMRRKNHTHQQDIDDLKRQNALLEQQVRALEKARSSAQLQTNYPSSDNSLYTNAKGSTISAFDGGSDSSSESEPEEPQSRKKLRMEAS

SEQ ID NO: 7187 - protein, 160 aa, Homo sapiens
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQVRALEKARSSAQLQTNYPSSDNSLYTNAKGSTISAFDGGSDSSSESEPEEPQSRKKLRMEAS

SEQ ID NO: 7188 - protein, 141 aa, Homo sapiens
MLSVKITSIFSIFFFLLFQEEQPRFQSAADKRAHHNALERKRRDHIKDSFHSLRDSVPSLQGEKASRAQILDKATEYIQYMRRKNHTHQQDIDDLKRQNALLEQQGEHPSSWGSWPCCAPARSGFGTWACRVRASHGVCAQ

SEQ ID NO: 7189 - protein, 103 aa, Homo sapiens
MSDNDDIEVESDEEQPRFQSAADKRAHHNALERKRRDHIKDSFHSLRDSVPSLQGEKASRAQILDKATEYIQYMRRKNHTHQQDIDDLKRQNALLEQQGESES

SEQ ID NO: 7190 - protein, 103 aa, Homo sapiens; identical to SEQ ID NO: 7189

SEQ ID NO: 7191 - protein, 4640 aa, Homo sapiens
MPVPDGSVAAAGLGLGLPAADSRGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEGLQSEPPEVLESLFQLLLEITVRSTGMNDSTGQSLTALSCACLFSLVASWGETGRTLQAISAILTNNGSHACQTIQVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAQLKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 7192 - protein, 513 aa, Homo sapiens
MQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKVLTVLPTAGDQLSAILNSIQSRPNLPAPSIFDQAAKPPSSLVHSPFVFGQPLSFQQPQLQSDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKRKIEFSFQRRWIQAFRASQASHVSFCGR

SEQ ID NO: 7193 - protein, 4678 aa, Homo sapiens
MMMCAATASPAAASSGLGGDGFYPAATFSSSPAPGALFMPVPDGSVAAAGLGLGLPAADSRGHYQLLLSGRALADRYRRIYTAALNDRDQGGGSAGHPASRNKKILNKKKLKRKQKSKSKVKTRSKSENLENTVIIPDIKLHSNPSAFNIYCNVRHCVLEWQKKEISLAAASKNSVQSGESDSDEEEESKEPPIKLPKIIEVGLCEVFELIKETRFSHPSLCLRSLQALLNVLQGQQPEGLQSEPPEVLESLFQLLLEITVRSTGMNDSTGQSLTALSCACLFSLVASWGETGRTLQAISAILTNNGSHACQTIQVPTILNSLQRSVQAVLVGKIQIQDWFSNGIKKAALMHKWPLKEISVDEDDQCLLQNDGFFLYLLCKDGLYKIGSGYSGTVRGHIYNSTSRIRNRKEKKSWLGYAQGYLLYRDVNNHSMTAIRISPETLEQDGTVMLPDCHTEGQNILFTDGEYINQIAASRDDGFVVRIFATSTEPVLQQELQLKLARKCLHACGISLFDLEKDLHIISTGFDEESAILGAGREFALMKTANGKIYYTGKYQSLGIKQGGPSAGKWVELPITKSPKIVHFSVGHDGSHALLVAEDGSIFFTGSASKGEDGESTKSRRQSKPYKPKKIIKMEGKIVVYTACNNGSSSVISKDGELYMFGKDAIYSDSSSLVTDLKGHFVTQVAMGKAHTCVLMKNGEVWTFGVNNKGQCGRDTGAMNQGGKGFGVENMATAMDEDLEEELDEKDEKSMMCPPGMHKWKLEQCMVCTVCGDCTGYGASCVSSGRPDRVPGGICGCGSGESGCAVCGCCKACARELDGQEARQRGILDAVKEMIPLDLLLAVPVPGVNIEEHLQLRQEEKRQRVIRRHRLEEGRGPLVFAGPIFMNHREQALARLRSHPAQLKHKRDKHKDGSGERGEKDASKITTYPPGSVRFDCELRAVQVSCGFHHSVVLMENGDVYTFGYGQHGQLGHGDVNSRGCPTLVQALPGPSTQVTAGSNHTAVLLMDGQVFTFGSFSKGQLGRPILDVPYWNAKPAPMPNIGSKYGRKATWIGASGDQTFLRIDEALINSHVLATSEIFASKHIIGLVPASISEPPPFKCLLINKVDGSCKTFNDSEQEDLQGFGVCLDPVYDVIWRFRPNTRELWCYNAVVADARLPSAADMQSRCSILSPELALPTGSRALTTRSHAALHILGCLDTLAAMQDLKMGVASTEEETQAVMKVYSKEDYSVVNRFESHGGGWGYSAHSVEAIRFSADTDILLGGLGLFGGRGEYTAKIKLFELGPDGGDHETDGDLLAETDVLAYDCAAREKYAMMFDEPVLLQAGWWYVAWARVSGPSSDCGSHGQASITTDDGVVFQFKSSKKSNNGTDVNAGQIPQLLYRLPTSDGSASKGKQQTSEPVHILKRSFARTVSVECFESLLSILHWSWTTLVLGVEELRGLKGFQFTATLLDLERLRFVGTCCLRLLRVYTCEIYPVSATGKAVVEETSKLAECIGKTRTLLRKILSEGVDHCMVKLDNDPQGYLSQPLSLLEAVLQECHNTFTACFHSFYPTPALQWACLCDLLNCLDQDIQEANFKTSSSRLLAAVMSALCHTSVKLTSIFPIAYDGEVLLRSIVKQVSTENDSTLVHRFPLLVAHMEKLSQSEENISGMTSFREVLEKMLVIVVLPVRNSLRRENELFSSHLVSNTCGLLASIVSELTASALGSEVDGLNSLHSVKASANRFTKTSQGRSWNTGNGSPDAICFSVDKPGIVVVGFSVYGGGGIHEYELEVLVDDSEHAGDSTHSHRWTSLELVKGTYTTDDSPSDIAEIRLDKVVPLKENVKYAVRLRNYGSRTANGDGGMTTVQCPDGVTFTFSTCSLSSNGTNQTRGQIPQILYYRSEFDGDLQSQLLSKANEEDKNCSRALSVVSTVVRASKDLLHRALAVDADDIPELLSSSSLFSMLLPLIIAYIGPVAAAIPKVAVEVFGLVQQLLPSVAILNQKYAPPAFNPNQSTDSTTGNQPEQGLSACTTSSHYAVIESEHPYKPACVMHYKVTFPECVRWMTIEFDPQCGTAQSEDVLRLLIPVRTVQNSGYGPKLTSVHENLNSWIELKKFSGSSGWPTMVLVLPGNEALFSLETASDYVKDDKASFYGFKCFAIGYEFSPGPDEGVIQLEKELANLGGVCAAALMKKDLALPIGNELEEDLEILEEAALQVCKTHSGILGKGLALSHSPTILEALEGNLPLQIQSNEQSFLDDFIACVPGSSGGRLARWLQPDSYADPQKTSLILNKDDIRCGWPTTITVQTKDQYGDVVHVPNMKVEVKAVPVSQKKMSLQQDQAKKPQRIPGSPAVTAASSNTDMTYGGLASPKLDVSYEPMIVKEARYIAITMMKVYENYSFEELRFASPTPKRPSENMLIRVNNDGTYCANWTPGAIGLYTLHVTIDGIEIDAGLEVKVKDPPKGMIPPGTQLVKPKSEPQPNKVRKFVAKDSAGLRIRSHPSLQSEQIGIVKVNGTITFIDEIHNDDGVWLRLNDETIKKYVPNMNGYTEAWCLSFNQHLGKSLLVPVDESKTNTDDFFKDINSCCPQEATMQEQDMPFLRGGPGMYKVVKTGPSGHNIRSCPNLRGIPIGMLVLGNKVKAVGEVTNSEGTWVQLDQNSMVEFCESDEGEAWSLARDRGGNQYLRHEDEQALLDQNSQTPPPSPFSVQAFNKGASCSAQGFDYGLGNSKGDRGNISTSSKPASTSGKSELSSKHSRSLKPDGRMSRTTADQKKPRGTESLSASESLILKSDAAKLRSDSHSRSLSPNHNTLQTLKSDGRMPSSSRAESPGPGSRLSSPKPKTLPANRSSPSGASSPRSSSPHDKNLPQKSTAPVKTKLDPPRERSKSDSYTLDPDTLRKKKMPLTEPLRGRSTSPKPKSVPKDSTDSPGSENRAPSPHVVQENLHSEVVEVCTSSTLKTNSLTDSTCDDSSEFKSVDEGSNKVHFSIGKAPLKDEQEMRASPKISRKCANRHTRPKKEKSSFLFKGDGSKPLEPAKQAMSPSVAECARAVFASFLWHEGIVHDAMACSSFLKFHPELSKEHAPIRSSLNSQQPTEEKETKLKNRHSLEISSALNMFNIAPHGPDISKMGSINKNKVLSMLKEPPLHEKCEDGKTETTFEMSMHNTMKSKSPLPLTLQHLVAFWEDISLATIKAASQNMIFPSPGSCAVLKKKECEKENKKSKKEKKKKEKAEVRPRGNLFGEMAQLAVGGPEKDTICELCGESHPYPVTYHMRQAHPGCGRYAGGQGYNSIGHFCGGWAGNCGDGGIGGSTWYLVCDRCREKYLREKQAAAREKVKQSRRKPMQVKTPRALPTMEAHQVIKANALFLLSLSSAAEPSILCYHPAKPFQSQLPSVKEGISEDLPVKMPCLYLQTLARHHHENFVGYQDDNLFQDEMRYLRSTSVPAPYISVTPDASPNVFEEPESNMKSMPPSLETSPITDTDLAKRTVFQRSYSVVASEYDKQHSILPARVKAIPRRRVNSGDTEVGSSLLRHPSPELSRLISAHSSLSKGERNFQWPVLAFVIQHHDLEGLEIAMKQALRKSACRVFAMEAFNWLLCNVIQTTSLHDILWHFVASLTPAPVEPEEEEDEENKTSKENSEQEKDTRVCEHPLSDIVIAGEAAHPLPHTFHRLLQTISDLMMSLPSGSSLQQMALRCWSLKFKQSDHQFLHQSNVFHHINNILSKSDDGDSEESFSISIQSGFEAMSQELCIVMCLKDLTSIVDIKTSSRPAMIGSLTDGSTETFWESGDEDKNKTKNITINCVKGINARYVSVHVDNSRDLGNKVTSMTFLTGKAVEDLCRIKQVDLDSRHIGWVTSELPGGDNHIIKIELKGPENTLRVRQVKVLGWKDGESTKIAGQISASVAQQRNCEAETLRVFRLITSQVFGKLISGDAEPTPEQEEKALLSSPEGEEKVYNATSDADLKEHMVGIIFSRSKLTNLQKQVCAHIVQAIRMEATRVREEWEHAISSKENANSQPNDEDASSDAYCFELLSMVLALSGSNVGRQYLAQQLTLLQDLFSLLHTASPRVQRQVTSLLRRVLPEVTPSRLASIIGVKSLPPADISDIIHSTEKGDWNKLGILDMFLGCIAKALTVQLKAKGTTITGTAGTTVGKGVTTVTLPMIFNSSYLRRGESHWWMKGSTPTQISEIIIKLIKDMAAGHLSEAWSRVTKNAIAETIIALTKMEEEFRSPVRCIATTRLWLALASLCVLDQDHVDRLSSGRWMGKDGQQKQMPMCDNHDDGETAAIILCNVCGNLCTDCDRFLHLHRRTKTHQRQVFKEEEEAIKVDLHEGCGRTKLFWLMALADSKTMKAMVEFREHTGKPTTSSSEACRFCGSRSGTELSAVGSVCSDADCQEYAKIACSKTHPCGHPCGGVKNEEHCLPCLHGCDKSATSLKQDADDMCMICFTEALSAAPAIQLDCSHIFHLQCCRRVLENRWLGPRITFGFISCPICKNKINHIVLKDLLDPIKELYEDVRRKALMRLEYEGLHKSEAITTPGVRFYNDPAGYAMNRYAYYVCYKCRKAYFGGEARCDAEAGRGDDYDPRELICGACSDVSRAQMCPKHGTDFLEYKCRYCCSVAVFFCFGTTHFCNACHDDFQRMTSIPKEELPHCPAGPKGKQLEGTECPLHVVHPPTGEEFALGCGVCRNAHTF

SEQ ID NO: 7194 - protein, 4640 aa, Homo sapiens; identical to SEQ ID NO: 7191

SEQ ID NO: 7195 - protein, 309 aa, Homo sapiens
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 7196 - protein, 285 aa, Homo sapiens
MAAGGPGAGSAAPVSSTSSLPLAALNMRVRRRLSLFLNVRTQVAADWTALAEEMDFEYLEIRQLETQADPTGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 7197 - protein, 317 aa, Homo sapiens
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRLARRPRGGCRRMVVVVSDDYLQSKECDFQTKFALSLSPGAHQKRLIPIKYKAMKKEFPSILRFITVCDYTNPCTKSWFWTRLAKALSLP

SEQ ID NO: 7198 - protein, 169 aa, Homo sapiens
MAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPPHLMTPWGICLSVSMPSSAIAPATSSLCRR

SEQ ID NO: 7199 - protein, 320 aa, Homo sapiens
MELLSPPLRDVDLTAPDGSLCSFATTDDFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 7200 - protein, 1845 aa, Homo sapiens
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSAPAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEGLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 7201 - protein, 714 aa, Homo sapiens
MKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 7202 - protein, 1863 aa, Homo sapiens
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSAPAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQLSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 7203 - protein, 1914 aa, Homo sapiens
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSAPAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQLSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 7204 - protein, 76 aa, Homo sapiens
MGDVKLVASSHISKTSLSVDPSRVDSMPLTEAPAFILPPRNLCIKEGATAKFEGRVRGYPEPQVTWHRNGQPITSG

SEQ ID NO: 7205 - protein, 1863 aa, Homo sapiens; identical to SEQ ID NO: 7202

SEQ ID NO: 7206 - protein, 154 aa, Homo sapiens
MAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 7207 - protein, 1914 aa, Homo sapiens; identical to SEQ ID NO: 7203

SEQ ID NO: 7208 - protein, 1976 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 7209 - protein, 2007 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPQESPKPVKHQGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDEIQNIQRASFYDSVSGLHEPPVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 7210 - protein, 1992 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPQESPKPVKHQASALLYGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 7211 - protein, 1997 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDEIQNIQRASFYDSVSGLHEPPVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGYLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 7212 - protein, 188 aa, Homo sapiens
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENT

SEQ ID NO: 7213 - protein, 1960 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 7214 - protein, 1382 aa, Homo sapiens
MYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 7215 - protein, 562 aa, Homo sapiens
ASGTRRRWPPTTSWRRPRRGCSRSWTTCWWTWTTSARARATWRRSRRSLTSSWRRRRPSLPSMQRSATGLRRRPERRRPRLCRWPGPEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 7216 - protein, 218 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQEAYFKNRAVRLGVL

SEQ ID NO: 7217 - protein, 103 aa, Homo sapiens
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKE

SEQ ID NO: 7218 - protein, 172 aa, Homo sapiens
MSSKRAKAKTTKKRPQRATSNVFAMFDQSQIQEFKEAFNMIDQNRDGFIDKEDLHDMLASLGKNPTDEYLEGMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 7219 - protein, 118 aa, Homo sapiens
MSSKRAKAKTTKKRPQRATSNVFAMFDQSQIQEFKEAFNMIDQNRDGFIDKEDLHDMLASLGFIHEDHLRELLTTMGDRFTDEEVDEMYREAPIDKKGNFNYVEFTRILKHGAKDKDD

SEQ ID NO: 7220 - protein, 308 aa, Homo sapiens
MQELTLSPGPAKLTPTLDPTHRMELILSTSPAELTLDPACQPKLPLDSTCQPEMTFNPGPTELTLDPEHQPEETPAPSLAELTLEPVHRRPELLDACADLINDQWPRSRTSRLHSLGQSSDAFPLCLMLLSPHPTLEAAPVVVGHARLSRVLNQPQSLLVETVVVARALRGRGFGRRLMEGLEVFARARGFRKLHLTTHDQVHFYTHLGYQLGEPVQGLVFTSRRLPATLLNAFPTAPSPRPPRKAPNLTAQAAPRGPKGPPLPPPPPLPECLTISPPVPSGPPSKSLLETQYQNVRGRPIFWMEKDI

SEQ ID NO: 7221 - protein, 286 aa, Homo sapiens
MELILSTSPAELTLDPACQPKLPLDSTCQPEMTFNPGPTELTLDPEHQPEETPAPSLAELTLEPVHRRPELLDACADLINDQWPRSRTSRLHSLGQSSDAFPLCLMLLSPHPTLEAAPVVVGHARLSRVLNQPQSLLVETVVVARALRGRGFGRRLMEGLEVFARARGFRKLHLTTHDQVHFYTHLGYQLGEPVQGLVFTSRRLPATLLNAFPTAPSPRPPRKAPNLTAQAAPRGPKGPPLPPPPPLPECLTISPPVPSGPPSKSLLETQYQNVRGRPIFWMEKDI

SEQ ID NO: 7222 - protein, 57 aa, Homo sapiens
MELILSTSPAELTLDPACQPKLPLDSTCQPEMTFNPGPTELTLDPEHQPEETPAPSL

SEQ ID NO: 7223 - protein, 286 aa, Homo sapiens; identical to SEQ ID NO: 7221

SEQ ID NO: 7224 - protein, 286 aa, Homo sapiens; identical to SEQ ID NO: 7221

SEQ ID NO: 7225 - protein, 86 aa, Homo sapiens
MELILSTSPAELTLDPACQPKLPLDSTCQPEMTFNPGPTELTLDPEHQPEETPAPSLAELTLEPVHRRPELLDACADLINDQWPRS

SEQ ID NO: 7226 - protein, 9 aa, Homo sapiens
MELILSTSP

SEQ ID NO: 7227 - protein, 328 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 7228 - protein, 371 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 7229 - protein, 357 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 7230 - protein, 357 aa, Homo sapiens; identical to SEQ ID NO: 7229

SEQ ID NO: 7231 - protein, 341 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 7232 - protein, 360 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 7233 - protein, 371 aa, Homo sapiens; identical to SEQ ID NO: 7228

SEQ ID NO: 7234 - protein, 371 aa, Homo sapiens; identical to SEQ ID NO: 7228

SEQ ID NO: 7235 - protein, 328 aa, Homo sapiens; identical to SEQ ID NO: 7227

SEQ ID NO: 7236 - protein, 341 aa, Homo sapiens; identical to SEQ ID NO: 7231

SEQ ID NO: 7237 - protein, 371 aa, Homo sapiens; identical to SEQ ID NO: 7228

SEQ ID NO: 7238 - protein, 367 aa, Homo sapiens
MENGGSMQATMAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 7239 - protein, 167 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDW

SEQ ID NO: 7240 - protein, 357 aa, Homo sapiens; identical to SEQ ID NO: 7229

SEQ ID NO: 7241 - protein, 173 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDP

SEQ ID NO: 7242 - protein, 252 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDIT

SEQ ID NO: 7243 - protein, 174 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTG

SEQ ID NO: 7244 - protein, 357 aa, Homo sapiens; identical to SEQ ID NO: 7229

SEQ ID NO: 7245 - protein, 149 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGA

SEQ ID NO: 7246 - protein, 86 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFE

SEQ ID NO: 7247 - protein, 129 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIP

SEQ ID NO: 7248 - protein, 148 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAG

SEQ ID NO: 7249 - protein, 134 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAG

SEQ ID NO: 7250 - protein, 108 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLD

SEQ ID NO: 7251 - protein, 120 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQY

SEQ ID NO: 7252 - protein, 99 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVH

SEQ ID NO: 7253 - protein, 92 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGME

SEQ ID NO: 7254 - protein, 153 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLV

SEQ ID NO: 7255 - protein, 357 aa, Homo sapiens; identical to SEQ ID NO: 7229

SEQ ID NO: 7256 - protein, 194 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIP

SEQ ID NO: 7257 - protein, 128 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIG

SEQ ID NO: 7258 - protein, 219 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRN

SEQ ID NO: 7259 - protein, 221 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWN

SEQ ID NO: 7260 - protein, 371 aa, Homo sapiens; identical to SEQ ID NO: 7228

SEQ ID NO: 7261 - protein, 143 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYAL

SEQ ID NO: 7262 - protein, 160 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPN

SEQ ID NO: 7263 - protein, 141 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTII

SEQ ID NO: 7264 - protein, 118 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQY

SEQ ID NO: 7265 - protein, 140 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTI

SEQ ID NO: 7266 - protein, 144 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALN

SEQ ID NO: 7267 - protein, 153 aa, Homo sapiens; identical to SEQ ID NO: 7254

SEQ ID NO: 7268 - protein, 224 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYN

SEQ ID NO: 7269 - protein, 150 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVE

SEQ ID NO: 7270 - protein, 127 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTII

SEQ ID NO: 7271 - protein, 149 aa, Homo sapiens
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTV

SEQ ID NO: 7272 - protein, 375 aa, Homo sapiens
MDELQDVQLTEIKPLLNDKNGTRNFQDFDCQEHDIETTHGVVHVTIRGLPKGNRPVILTYHDIGLNHKSCFNAFFNFEDMQEITQHFAVCHVDAPGQQEGAPSFPTGYQYPTMDELAEMLPPVLTHLSLKSIIGIGVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPSASMTRLARSRTHSTSSSLGSGESPFSRSVTSNQSDGTQESCESPDVLDRHQTMEVSC

SEQ ID NO: 7273 - protein, 363 aa, Homo sapiens
MDELQDVQLTEIKPLLNDKEHDIETTHGVVHVTIRGLPKGNRPVILTYHDIGLNHKSCFNAFFNFEDMQEITQHFAVCHVDAPGQQEGAPSFPTGYQYPTMDELAEMLPPVLTHLSLKSIIGIGVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPSASMTRLARSRTHSTSSSLGSGESPFSRSVTSNQSDGTQESCESPDVLDRHQTMEVSC

SEQ ID NO: 7274 - protein, 280 aa, Homo sapiens
MVQETSRTLTVRYQYPTMDELAEMLPPVLTHLSLKSIIGIGVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPSASMTRLARSRTHSTSSSLGSGESPFSRSVTSNQSDGTQESCESPDVLDRHQTMEVSC

SEQ ID NO: 7275 - protein, 271 aa, Homo sapiens [sequence omitted]

SEQ ID NO: 7276 - protein, 139 aa, Homo sapiens
MPEGPELHLASQFVNEACRALVFGGCVEKSSVSRNPEVPFESSAYRISASARGKELRLILSPLPGAQPQQEPRAPRGAATPCPPALLHGPAWPPARPMFRGHPPVRPLGPWGKVAAGPRALCLAGVPAVQGECATKPSG

SEQ ID NO: 7277 - protein, 390 aa, Homo sapiens
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRENVLRNLADKAFDRPICEALLDQRFFNGIGNYLRAEILYRLKIPPFEKARSVLEALQQHRPSPELTLSQKIRTKLQNPDLLELCHSVPKEVVQLGGKGYGSESGEEDFAAFRAWLRCYGMPGMSSLQDRHGRTIWFQGDPGPLAPKGRKSRKKKSKATQLSPEDRVEDALPPSKAPSRTRRAKRDLPKRTATQRPEGTSLQQDPEAPTVPKKGRRKGRQAASGHCRPRKVKADIPSLEPEGTSAS

SEQ ID NO: 7278 - protein, 390 aa, Homo sapiens; identical to SEQ ID NO: 7277

SEQ ID NO: 7279 - protein, 332 aa, Homo sapiens
MPEGPLVRKFHHLVSPFVGQQVVKTGGSSKKLQPASLQSLWLQDTQVHGKKLFLRFDLDEEMGPPGSSPTPEPPQKEVQKEGAADPKQVGEPSGQKTLDGSSRSAELVPQGEDDSEYLERDAPAGDAGRWLRVSFGLFGSVWVNDFSRAKKANKRGDWRDPSPRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 7280 - protein, 317 aa, Homo sapiens
MPEGPLVRKFHHLVSPFVGQQVVKTGGSSKKLQPASLQSLWLQDTQVHGKKLFLRFDLDEEMGPPGSSPTPEPPQKEVQKKTLDGSSRSAELVPQGEDDSEYLERDAPAGDAGRWLRVSFGLFGSVWVNDFSRAKKANKRGDWRDPSPRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 7281 - protein, 271 aa, Homo sapiens
MGPPGSSPTPEPPQKEVQKEGAADPKQVGEPSGQKTLDGSSRSAELVPQGEDDSEYLERDAPAGDAGRWLRVSFGLFGSVWVNDFSRAKKANKRGDWRDPSPRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 7282 - protein, 332 aa, Homo sapiens; identical to SEQ ID NO: 7279

SEQ ID NO: 7283 - protein, 332 aa, Homo sapiens; identical to SEQ ID NO: 7279

SEQ ID NO: 7284 - protein, 216 aa, Homo sapiens
MPEGPLVRKFHHLVSPFVGQQVVKTGGSSKKLQPASLQSLWLQDTQVRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 7285 - protein, 605 aa, Homo sapiens
MVEGPGCTLNGEKIRARVLPGQAVTGVRGSALRSLQGRALRLAASTVVVSPQAAALNNDSSQNVLSLFNGYVYSGVETLGKELFMYFGPKALRIHFGMKGFIMINPLEYKYKNGASPVLEVQLTKDLICFFDSSVELRNSMESQQRIRMMKELDVCSPEFSFLRAESEVKKQKGRMLGDVLMDQNVLPGVGNIIKNEALFDSGLHPAVKVCQLTDEQIHHLMKMIRDFSILFYRCRKAGLALSKHYKVYKRPNCGQCHCRITVCRFGDNNRMTYFCPHCQKENPQHVDICKLPTRNTIISWTSSRVDHVMDSVARKSEEHWTCVVCTLINKPSSKACDACLTSRPIDSVLKSEENSTVFSHLMKYPCNTFGKPHTEVKINRKTAFGTTTLVLTDFSNKSSTLERKTKQNQILDEEFQNSPPASVCLNDIQHPSKKTTNDITQPSSKVNISPTISSESKLFSPAHKKPKTAQYSSPELKSCNPGYSNSELQINMTDGPRTLNPDSPRCSKHNRLCILRVVGKDGENKGRQFYACPLPREAQCGFFEWADLSFPFCNHGKRSTMKTVLKIGPNNGKNFFVCPLGKEKQCNFFQWAENGPGIKIIPGC

SEQ ID NO: 7286 - protein, 580 aa, Homo sapiens
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDSSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 7287 - protein, 848 aa, Homo sapiens
LFCFVFSVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVPGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 7288 - protein, 664 aa, Homo sapiens
ITIRDEIWVLFCFVFSVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQAPPPTASASSSTPVPLSPPDTTWPLPALATTEPAKNIAQNHCCNMFQAGLHNALMK

SEQ ID NO: 7289 - protein, 313 aa, Homo sapiens
MEGIVTIVGLKPETTYAVRLAALNGKGLGEISAASEFKTQPVHSPPPPASASSSTPVPLSPPDTGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 7290 - protein, 189 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNSKSFADINLYREQIKRVKDSDDVPMVLVGNKCDLPTRTVDTKQAHELAKSYGIPFIETSAKTRQGVEDAFYTLVREIRQYRMKKLNSSDDGTQGCMGLPCVVM

SEQ ID NO: 7291 - protein, 216 aa, Homo sapiens
MPGNLMSQTSRAVSIWKFPAKLGKTHGHRALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 7292 - protein, 181 aa, Homo sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 7293 - protein, 116 aa, Homo sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKIL

SEQ ID NO: 7294 - protein, 163 aa, Homo sapiens
MLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPE

SEQ ID NO: 7295 - protein, 117 aa, Homo sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILH

SEQ ID NO: 7296 - protein, 109 aa, Homo sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVD

SEQ ID NO: 7297 - protein, 128 aa, Homo sapiens
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPS

SEQ ID NO: 7298 - protein, 180 aa, Homo sapiens
MLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 7299 - protein, 2818 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 7300 - protein, 2839 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 7301 - protein, 204 aa, Homo sapiens
MHERYSNVQVAGPVDRTSSKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRNKEKF

SEQ ID NO: 7302 - protein, 593 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEIRYMYFYFLNSTFKFYFVFLS

SEQ ID NO: 7303 - protein, 638 aa, Homo sapiens
MHERYSNVQVAGPVDRTSSKFCGSFNCRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKLALLNLLTAHQNSL

SEQ ID NO: 7304 - protein, 2502 aa, Homo sapiens
NWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPASLPCSKSAVFMQLFPHQGIDKENVELSPTTGHCNSGRTRHGSASQVQKQRSAGSFKRNSIKKIV

SEQ ID NO: 7305 - protein, 507 aa, Homo sapiens
MAGAIASRMSFSSLKRKQPKTFTVRIVTMDAEMEFNCEVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 7306 - protein, 595 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKLTLQSAKSRVAFFEEL

SEQ ID NO: 7307 - protein, 220 aa, Homo sapiens
MAGAIASRMSFSSLKRKQPKTFTVRIVTMDAEMEFNCEVKKQILDEKIYCPPEASVLLASYAVQAKNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQGQRGRSAEAGPAGSTRGGAKSQAEAPGDCHQAHVPAHEPNSSTVAS

SEQ ID NO: 7308 - protein, 507 aa, Homo sapiens; identical to SEQ ID NO: 7305

SEQ ID NO: 7309 - protein, 590 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 7310 - protein, 549 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 7311 - protein, 548 aa, Homo sapiens
MAGAIASRMSFSSLKRKQPKTFTVRIVTMDAEMEFNCEVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 7312 - protein, 590 aa, Homo sapiens; identical to SEQ ID NO: 7309

SEQ ID NO: 7313 - protein, 601 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKGMFLFFFILFCWFSLKPKAEDLSAFEPSNSPCRAPSPEWPSLKSSSR

SEQ ID NO: 7314 - protein, 561 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 7315 - protein, 590 aa, Homo sapiens; identical to SEQ ID NO: 7309

SEQ ID NO: 7316 - protein, 165 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKLTLQSAKSRVAFFEEL

SEQ ID NO: 7317 - protein, 220 aa, Homo sapiens; identical to SEQ ID NO: 7307

SEQ ID NO: 7318 - protein, 923 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 7319 - protein, 139 aa, Homo sapiens
MDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSGSRFFKHHHKQQSMRPQNLHHNSILLL

SEQ ID NO: 7320 - protein, 641 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEGTINTDQECPCARALAKDAKKKKRWADSTHCRCVRSIHGEMWSSGKGVCSLDANL

SEQ ID NO: 7321 - protein, 188 aa, Homo sapiens
MSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQDAKYRLRVSVVRSKSSSSSTSLEPRPLSSLKLSFFSYKIKIT

SEQ ID NO: 7322 - protein, 609 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEGGTTVLATEKPTVIDSTIQSGIK

SEQ ID NO: 7323 - protein, 644 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSGIK

SEQ ID NO: 7324 - protein, 704 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGAETIFIPLLYHFSSCLSWDQLTPVCVLVTPHGRELPRNRSCLARTRASSFPHVIWIDELFLIATTICNNNLSHFESQRLGLS

SEQ ID NO: 7325 - protein, 86 aa, Homo sapiens
MELLGCEVEAPTAGPTTPNGNLVDECDDDQANCHSGTGDDFQLTGGTTVLATEKPTVIDSTIQSARLEVSTLNLSLHNPPQQKALI

SEQ ID NO: 7326 - protein, 923 aa, Homo sapiens; identical to SEQ ID NO: 7318

SEQ ID NO: 7327 - protein, 735 aa, Homo sapiens
MSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 7328 - protein, 906 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCARSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 7329 - protein, 105 aa, Homo sapiens
NHISQEDCARSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 7330 - protein, 77 aa, Homo sapiens
  MOD_RES (1)..(1): Any amino acid
XPTAGPTTPNGNLVDECDDDQANCHSGTGDDFQLTGGTTVLATEKPTVIDSTIQSARLEVSTLNLSLHNPPQQKALI

SEQ ID NO: 7331 - protein, 100 aa, Homo sapiens
  MOD_RES (1)..(1): Any amino acid
XTHGGLGLRMELLGCEVEAPTAGPTTPNGNLVDECDDDQANCHSGTGDDFQLTGGTTVLATEKPTVIDSTIQSGSRFFKHHHKQQSMRPQNLHHNSILLL

SEQ ID NO: 7332 - protein, 236 aa, Homo sapiens
VDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKVRAGDWEEVIPYVLDFNQGPLAFSR

SEQ ID NO: 7333 - protein, 170 aa, Homo sapiens
  MOD_RES (1)..(1): Any amino acid
XPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQDAKYRLRVSVVRSKSSSSSTSLEPRPLSSLKLSFFSYKIKIT

SEQ ID NO: 7334 - protein, 906 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 7335 - protein, 99 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCNLLSAWKISLTSRSFA

SEQ ID NO: 7336 - protein, 555 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKVGCSWRPL

SEQ ID NO: 7337 - protein, 901 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 7338 - protein, 926 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 7339 - protein, 931 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 7340 - protein, 909 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFADEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 7341 - protein, 555 aa, Homo sapiens; identical to SEQ ID NO: 7336

SEQ ID NO: 7342 - protein, 102 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLG

SEQ ID NO: 7343 - protein, 926 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMATVSASIVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 7344 - protein, 909 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMGPKACIADEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 7345 - protein, 153 aa, Homo sapiens
MTKIKADPDGPEAQAEACSGERTYQELLVNQNPIAQPLASRRLTRKLYKCIKKAVKQKQIRRGVKEVQKFVNKGEKGIMVLAGDTLPIEVYCHLPVMCEDRNLPYVYIPSKTDLGAAAGSKRPTCVIMVKPHEEYQEAYDECLEEVQSLPLPL

SEQ ID NO: 7346 - protein, 90 aa, Homo sapiens
MTKIKADPDGPEAQAEACSGERTYQELLVNQNPIAQPLASRRLTRKLYKCIKKAVKQKQIRRGVKEVQKFVNKGEKGTWVQPQAPSAPPV

SEQ ID NO: 7347 - protein, 754 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 7348 - protein, 478 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERLHLKKKKKKK

SEQ ID NO: 7349 - protein, 380 aa, Homo sapiens
MGSGCRIECIFFSEFHPTLGPKITYQVPEDFISRELFDTVQVYIITKPELQNKLITVTAMEKKLIGCPVCIEHKKYSRNALLFNLGFVCDAQAKTCALEPIVKKLAGYLTTLELESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERKLIQFGLMKNLIRRLQKYPVRVTREEQSHPARLYTGCHSYDEICCKTGMSYHELDERLENDPNIIICWK

SEQ ID NO: 7350 - protein, 401 aa, Homo sapiens
MWSGGSGKARGWEAAAGGRSSPGRLSRRRIMSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 7351 - protein, 371 aa, Homo sapiens
MSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 7352 - protein, 371 aa, Homo sapiens; identical to SEQ ID NO: 7351

SEQ ID NO: 7353 - protein, 371 aa, Homo sapiens; identical to SEQ ID NO: 7351

SEQ ID NO: 7354 - protein, 34 aa, Homo sapiens
MWSGGSGKARGWEAAAGGRSSPGRLSAYAPPLVA

SEQ ID NO: 7355 - protein, 190 aa, Homo sapiens
MLRVPEPRPGEAKAEGAAPPTPSKPLTSFLIQDILRDGAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 7356 - protein, 234 aa, Homo sapiens
MLRVPEPRPGEAKAEGAAPPTPSKPLTSFLIQDILRDGAQRQGGRTSSQRQRDPEPEPEPEPEGGRSRAGAQNDQLSTGPRAAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 7357 - protein, 159 aa, Homo sapiens
MLRVPEPRPGEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 7358 - protein, 1403 aa, Homo sapiens
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCVRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 7359 - protein, 1241 aa, Homo sapiens
MPLHIGDFVWDSKVHSLQSSLNIFSLLPTKGRTEHLFFSHILSFHWPAFSSIRLELWINLRCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCVRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 7360 - protein, 1403 aa, Homo sapiens; identical to SEQ ID NO: 7358

SEQ ID NO: 7361 - protein, 1241 aa, Homo sapiens; identical to SEQ ID NO: 7359

SEQ ID NO: 7362 - protein, 298 aa, Homo sapiens
MVTPALQMKKPKQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 7363 - protein, 293 aa, Homo sapiens
MPARSGAQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 7364 - protein, 281 aa, Homo sapiens
MGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 7365 - protein, 251 aa, Homo sapiens
MGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAG

SEQ ID NO: 7366 - protein, 347 aa, Homo sapiens
MHAHCLPFLLHAWWALLQAGAATVATALLRTRGQPSSPSPLAYMLSLYRDPLPRADIIRSLQAEDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKHPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 7367 - protein, 292 aa, Homo sapiens
DQQLGIQTKDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKHPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 7368 - protein, 177 aa, Homo sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 7369 - protein, 177 aa, Homo sapiens; identical to SEQ ID NO: 7368

SEQ ID NO: 7370 - protein, 152 aa, Homo sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 7371 - protein, 60 aa, Homo sapiens
MVLLSTLGIVFQGEGPPISSCDTGTMANCERTFIAIKPDGVQRGLVGEIIKRFEQKGFRL

SEQ ID NO: 7372 - protein, 187 aa, Homo sapiens
MGGLFWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 7373 - protein, 195 aa, Homo sapiens
MGGLFWRSALRGLRCGPRAPGPSLLVRHGSGLPPSALKRGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 7374 - protein, 117 aa, Homo sapiens
MKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 7375 - protein, 169 aa, Homo sapiens
  MOD_RES (1)..(1): Any amino acid
XWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISSHRLAPLDRGQREQQMVPGIPQGAHEA

SEQ ID NO: 7376 - protein, 233 aa, Homo sapiens
MGGLFWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELSPTGAPWPSRRPTWRGTTVSPRTATSSARTCCGTKWPSSQEAALGLGSGLLRFSCGTAAIR

SEQ ID NO: 7377 - protein, 117 aa, Homo sapiens; identical to SEQ ID NO: 7374

SEQ ID NO: 7378 - protein, 37 aa, Homo sapiens
MKMLQAPESVLAEHYQDLRRKPFYPALIRYMSSGPVV

SEQ ID NO: 7379 - protein, 64 aa, Homo sapiens
MFLQYYLNEQGDRVYTLKKFDPMGQQTCSAHPARFSPDDKYSRHRITIKKRFKVLMTQQPRPVL

SEQ ID NO: 7380 - protein, 2555 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 7381 - protein, 2003 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTVYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 7382 - protein, 186 aa, Homo sapiens
MSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGADAAIPGGAGRSGGSSPATAGAGGSPRAAGPGWASAGGRRSPT

SEQ ID NO: 7383 - protein, 312 aa, Homo sapiens
MCSPQESGMTALSARMLTRSRSLGPGAGPRGCREEPGPLRRREAAAEARKSHSPVKRPRKAQRLRVAYEGSDSEKGEGAEPLKVPVWEPQDWQQQLVNIRAMRNKKDAPVDHLGTEHCYDSSAPPKVRRYQVLLSLMLSSQTKDQVTAGAMQRLRARGLTVDSILQTDDATLGKLIYPVGFWRSKVKYIKQTSAILQQHYGGDIPASVAELVALPGVGPKMAHLAMAVAWGTVSGIAVDTHVHRIANRLRWTKKATKSPEETRAALEEWLPRELWHEINGLLVGFGQQTCLPVHPRCHACLNQALCPAAQGL

SEQ ID NO: 7384 - protein, 1455 aa, Homo sapiens
MGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 7385 - protein, 1548 aa, Homo sapiens
MPSDFISLLSADLDLESPKSLYSRDSLKLHPSQNFHRAGLLEESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 7386 - protein, 1455 aa, Homo sapiens; identical to SEQ ID NO: 7384

SEQ ID NO: 7387 - protein, 1531 aa, Homo sapiens
MPSDFISLLSADLDLESPKSLYSRESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 7388 - protein, 1455 aa, Homo sapiens; identical to SEQ ID NO: 7384

SEQ ID NO: 7389 - protein, 1548 aa, Homo sapiens; identical to SEQ ID NO: 7385

SEQ ID NO: 7390 - protein, 1549 aa, Homo sapiens
MPSDFISLLSADLDLESPKSLYSRDSLKLHPSQNFHRAGLLEESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 7391 - protein, 716 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANGNAIFLTVSREHERVGCFF

SEQ ID NO: 7392 - protein, 825 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 7393 - protein, 943 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 7394 - protein, 930 aa, Homo sapiens
MTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 7395 - protein, 353 aa, Homo sapiens
MLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 7396 - protein, 907 aa, Homo sapiens
MKSGTLEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 7397 - protein, 914 aa, Homo sapiens
MTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDD

SEQ ID NO: 7398 - protein, 713 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVNEIIRNDLSSTSTHS

SEQ ID NO: 7399 - protein, 471 aa, Homo sapiens
MLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 7400 - protein, 921 aa, Homo sapiens
MNAPERQPQPDGGDAPGHEPGGSPQDELDFSILFDYEYLNPNEEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 7401 - protein, 325 aa, Homo sapiens
MSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPSTAPHLLSPFMFISQPGVHTRINVWALSGLSLKELATSL

SEQ ID NO: 7402 - protein, 925 aa, Homo sapiens
MNAPERQPQPDGGDAPGHEPGGSPQDELDFSILFDYEYLNPNEEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDVNEIIRKEFSGPPARNQT

SEQ ID NO: 7403 - protein, 901 aa, Homo sapiens
MQREAAFRLGHCHPLRIMGSVDQEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 7404 - protein, 1068 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDQFISDLEHQPSGSAEKWPNHSVLSCPAPFWRI

SEQ ID NO: 7405 - protein, 1075 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 7406 - protein, 1065 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDLFTSNNFDLLQLRPTFWPVPAGRYLRNLE

SEQ ID NO: 7407 - protein, 589 aa, Homo sapiens
MFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDQFISDLEHQPSGSAEKWPNHSVLSCPAPFWRI

SEQ ID NO: 7408 - protein, 902 aa, Homo sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 7409 - protein, 964 aa, Homo sapiens
MITTLPSLLPASLASISHRVTNLPSNSLSHNPGLSKPDFPGNSSPGLPSSSSPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 7410 - protein, 889 aa, Homo sapiens
MPASISSIFPGPTLLLSCGSEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 7411 - protein, 914 aa, Homo sapiens
MLSGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 7412 - protein, 933 aa, Homo sapiens
MADGGADSAAQRLPEGPGRVAPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 7413 - protein, 826 aa, Homo sapiens
MADGGADSAAQRLPEGPGRVAPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 7414 - protein, 901 aa, Homo sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 7415 - protein, 832 aa, Homo sapiens
MHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 7416 - protein, 794 aa, Homo sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 7417 - protein, 832 aa, Homo sapiens; identical to SEQ ID NO: 7415

SEQ ID NO: 7418 - protein, 329 aa, Homo sapiens
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 7419 - protein, 857 aa, Homo sapiens
MITTLPSLLPASLASISHRVTNLPSNSLSHNPGLSKPDFPGNSSPGLPSSSSPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 7420 - protein, 724 aa, Homo sapiens
MHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 7421 - protein, 143 aa, Homo sapiens
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSP

SEQ ID NO: 7422 - protein, 807 aa, Homo sapiens
MLSGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 7423 - protein, 436 aa, Homo sapiens
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 7424 - protein, 189 aa, Homo sapiens
MDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 7425 - protein, 890 aa, Homo sapiens
MPASISSIFPGPTLLLSCGSEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 7426 - protein, 915 aa, Homo sapiens
MLSGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 7427 - protein, 190 aa, Homo sapiens
MDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 7428 - protein, 782 aa, Homo sapiens
MPASISSIFPGPTLLLSCGSEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 7429 - protein, 934 aa, Homo sapiens
MADGGADSAAQRLPEGPGRVAPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 7430 - protein, 437 aa, Homo sapiens
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 7431 - protein, 831 aa, Homo sapiens
MHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 7432 - protein, 82 aa, Homo sapiens
MDFSPPRPPYPSYPHEDPACETPYLSEGFGYGMPPLYPQTGPPPSYRPGLRMFPETRGTTVSEIIGRDLSGFPAPPGEEPPA

SEQ ID NO: 7433 - protein, 969 aa, Homo sapiens
MAEDDPYLGRPEQMFHLDPSLTHTIFNPEVFQPQMALPTADGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 7434 - protein, 968 aa, Homo sapiens
MAEDDPYLGRPEQMFHLDPSLTHTIFNPEVFQPQMALPTDGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 7435 - protein, 968 aa, Homo sapiens; identical to SEQ ID NO: 7434

SEQ ID NO: 7436 - protein, 145 aa, Homo sapiens
MAEDDPYLGRPEQMFHLDPSLTHTIFNPEVFQPQMALPTADGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHV

SEQ ID NO: 7437 - protein, 74 aa, Homo sapiens
MKRTTSFRMAEDDPYLGRPEQMFHLDPSLTHTIFNPEVFQPQMALPTDGPYLQILEQPKQRGFRFRYVCEGPSH

SEQ ID NO: 7438 - protein, 317 aa, Homo sapiens
MFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 7439 - protein, 1158 aa, Homo sapiens
MTHGEELGSDVHQDSIVLTYLEGLLMHQAAGGSGTAVDKKSAGHNEEDQNFNISGSAFPTCQSNGPVLNTHTYQGSGMLHLKKARLLQSSEDWNAAKRKRLSDSIMNLNVKKEALLAGMVDSVPKGKQDSTLLASLLQSFSSRLQTVALSQQIRQSLKEQGYALSHDSLKVEKDLRCYGVASSHLKTLLKKSKVKDQKPDTNLPDVTKNLIRDRFAESPHHVGQSGTKVMSEPLSCAARLQAVASMVEKRASPATSPKPSVACSQLALLLSSEAHLQQYSREHALKTQNANQAASERLAAMARLQENGQKDVGSYQLPKGMSSHLNGQARTSSSKLMASKSSATVFQNPMGIIPSSPKNAGYKNSLERNNIKQAANNSLLLHLLKSQTIPKPMNGHSHSERGSIFEESSTPTTIDEYSDNNPSFTDDSSGDESSYSNCVPIDLSCKHRTEKSESDQPVSLDNFTQSLLNTWDPKVPDVDIKEDQDTSKNSKLNSHQKVTLLQLLLGHKNEENVEKNTSPQGVHNDVSKFNTQNYARTSVIESPSTNRTTPVSTPPLLTSSKAGSPINLSQHSLVIKWNSPPYVCSTQSEKLTNTASNHSMDLTKSKDPPGEKPAQNEGAQNSATFSASKLLQNLAQCGMQSSMSVEEQRPSKQLLTGNTDKPIGMIDRLNSPLLSNKTNAVEENKAFSSQPTGPEPGLSGSEIENLLERRTVLQLLLGNPNKGKSEKKEKTPLRDESTQEHSERALSEQILMVKIKSEPCDDLQIPNTNVHLSHDAKSAPFLGMAPAVQRSAPALPVSEDFKSEPVSPQDFSFSKNGLLSRLLRQNQDSYLADDSDRSHRNNEMALLESKNLCMVPKKRKLYTEPLENPFKKMKNNIVDAANNHSAPEVLYGSLLNQEELKFSRNDLEFKYPAGHGSASESEHRSWARESKSFNVLKQLLLSENCVRDLSPHRSNSVADSKKKGHKNNVTNSKPEFSISSLNGLMYSSTQPSSCMDNRTFSYPGVVKTPVSPTFPEHLGCAGSRPESGLLNGCSMPSEKGPIKWVITDAEKNEYEKDSPRLTKTNPILYYMLQKGGNSVTSRETQDKDIWREASSAESVSQVTAKEELLPTAETKASFFNLRSPYNSHMGNNASRPHSANGEVYGLLGSVLTIKKESE

SEQ ID NO: 7440 - protein, 1158 aa, Homo sapiens; identical to SEQ ID NO: 7439

SEQ ID NO: 7441 - protein, 1158 aa, Homo sapiens; identical to SEQ ID NO: 7439

SEQ ID NO: 7442 - protein, 66 aa, Homo sapiens
MTHGEELGSDVHQDSIVLTYLEGLLMHQAAGGSGTAVDKKSAGHNEEDQNFNISGSAFPTCQSNGP

SEQ ID NO: 7443 - protein, 778 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGRQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 7444 - protein, 777 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 7445 - protein, 593 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEVVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 7446 - protein, 777 aa, Homo sapiens; identical to SEQ ID NO: 7444

SEQ ID NO: 7447 - protein, 778 aa, Homo sapiens; identical to SEQ ID NO: 7443

SEQ ID NO: 7448 - protein, 742 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHENVMWLKPESTSHTLI

SEQ ID NO: 7449 - protein, 380 aa, Homo sapiens
MRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 7450 - protein, 751 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 7451 - protein, 144 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSAS

SEQ ID NO: 7452 - protein, 145 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSAST

SEQ ID NO: 7453 - protein, 777 aa, Homo sapiens; identical to SEQ ID NO: 7444

SEQ ID NO: 7454 - protein, 778 aa, Homo sapiens; identical to SEQ ID NO: 7443

SEQ ID NO: 7455 - protein, 145 aa, Homo sapiens; identical to SEQ ID NO: 7452

SEQ ID NO: 7456 - protein, 145 aa, Homo sapiens; identical to SEQ ID NO: 7452

SEQ ID NO: 7457 - protein, 145 aa, Homo sapiens; identical to SEQ ID NO: 7452

SEQ ID NO: 7458 - protein, 637 aa, Homo sapiens
MHDSIRFGNVDMPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRYCPTDQAAAGTDAEHVQQFYNLLTASIDVSRSWAEKIPGFTDLPKEDQTLLIESAFLELFVLRLSIRSNTAEDKFVFCNGLVLHRLQCLRGFGEWLDSIKDFSLNLQSLNLDIQALACLSALSMITERHGLKEPKRVEELCNKITSSLKDHQSKGQALEPTESKVLGALVELRKICTLGLQRIFYLKLEDLVSPPSIIDKLFLDTLPF

SEQ ID NO: 7459 - protein, 443 aa, Homo sapiens
MPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRVSFMISCFQMNDQGLYLWLLVIRVD

SEQ ID NO: 7460 - protein, 297 aa, Homo sapiens
MKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRVSFMISCFQMNDQGLYLWLLVIRVLDSFHTFSIFLASFSNSVHPLQQIIFALLNL

SEQ ID NO: 7461 - protein, 626 aa, Homo sapiens
MPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRYCPTDQAAAGTDAEHVQQFYNLLTASIDVSRSWAEKIPGFTDLPKEDQTLLIESAFLELFVLRLSIRSNTAEDKFVFCNGLVLHRLQCLRGFGEWLDSIKDFSLNLQSLNLDIQALACLSALSMITERHGLKEPKRVEELCNKITSSLKDHQSKGQALEPTESKVLGALVELRKICTLGLQRIFYLKLEDLVSPPSIIDKLFLDTLPF

SEQ ID NO: 7462 - protein, 208 aa, Homo sapiens
MGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESEDS

SEQ ID NO: 7463 - protein, 208 aa, Homo sapiens; identical to SEQ ID NO: 7462

SEQ ID NO: 7464 - protein, 710 aa, Homo sapiens
MVKLAKAGKNQGDPKKMAPPPKEVEEDSEDEEMSEDEEDDSSGEEVVIPQKKGKKAAATSAKKVVVSPTKKVAVATPAKKAAVTPGKKAAATPAKKTVTPAKAVTTPGKKGATPGKALVATPGKKGAAIPAKGAKNGKNAKKEDSDEEEDDDSEEDEEDDEDEDEDEDEIEPAAMKAAAAAPASEDEDDEDDEDDEDDDDDEEDDSEEEAMETTPAKGKKAAKVVPVKAKNVAEDEDEEEDDEDEDDDDDEDDEDDDDEDDEEEEEEEEEEPVKEAPGKRKKEMAKQKAAPEAKKQKVEGTEPTTAFNLFVGNLNFNKSAPELKTGISDVFAKNDLAVVDVRIGMTRKFGYVDFESAEDLEKALELTGLKVFGNEIKLEKPKGKDSKKERDARTLLAKNLPYKVTQDELKEVFEDAAEIRLVSKDGKSKGIAYIEFKTEADAEKTFEEKQGTEIDGRSISLYYTGEKGQNQDYRGGKNSTWSGESKTLVLSNLSYSATEETLQEVFEKATFIKVPQNQNGKSKGYAFIEFASFEDAKEALNSCNKREIEGRAIRLELQGPRGSPNARSQPSKTLFVKGLSEDTTEETLKESFDGSVRARIVTDRETGSSKGFGFVDFNSEEDAKAAKEAMEDGEIDGNKVTLDWAKPKGEGGFGGRGGGRGGFGGRGGGRGGRGGFGGRGRGGFGGRGGFRGGRGGGGDHKPQGKKTKFE

SEQ ID NO: 7465 - protein, 482 aa, Homo sapiens
MVKLAKAGKNQGDPKKMAPPPKEVEEDSEDEEMSEDEEDDSSGEEVVIPQKKGKKAAATSAKKVVVSPTKKVAVATPAKKAAVTPGKKAAATPAKKTVTPAKAVTTPGKKGATPGKALVATPGKKGAAIPAKGAKNGKNAKKEDSDEEEDDDSEEDEEDDEDEDEDEDEIEPAAMKAAAAAPASEDEDDEDDEDDEDGKSKGIAYIEFKTEADAEKTFEEKQGTEIDGRSISLYYTGEKGQNQDYRGGKNSTWSGESKTLVLSNLSYSATEETLQEVFEKATFIKVPQNQNGKSKGYAFIEFASFEDAKEALNSCNKREIEGRAIRLELQGPRGSPNARSQPSKTLFVKGLSEDTTEETLKESFDGSVRARIVTDRETGSSKGFGFVDFNSEEDAKAAKEAMEDGEIDGNKVTLDWAKPKGEGGFGGRGGGRGGFGGRGGGRGGRGGFGGRGRGGFGGRGGFRGGRGGGGDHKPQGKKTKFE

SEQ ID NO: 7466 - protein, 602 aa, Homo sapiens
MVKLAKAGKNQGDPKKMAPPPKEVEEDSEDEEMSEDEEDDSSGEELNDDFYQTTMHTLWKKGKKAAATSAIPAKGAKNGKNAKKEDSDEEEDDDSEEDEEDDEDEDEDEDEIEPAAMKAAAAAPASEDEDDEDDEDDEDDDDDEEDDDDDEDDEEEEEEEEEEPVKEAPGKRKKEMAKQKAAPEAKKQKVEGTEPTTAFNLFVGNLNFNKSAPELKTGISDVFAKNDLAVVDVRIGMTRKFGYVDFESAEDLEKALELTGLKVFGNEIKLEKPKGKDSKKERDARTLLAKNLPYKVTQDELKEVFEDAAEIRLVSKDGKSKGIAYIEFKTEADAEKTFEEKQGTEIDGRSISLYYTGEKGQNQDYRGGKNSTWSGESKTLVLSNLSYSATEETLQEVFEKATFIKVPQNQNGKSKGYAFIEFASFEDAKEALNSCNKREIEGRAIRLELQGPRGSPNARSQPSKTLFVKGLSEDTTEETLKESFDGSVRARIVTDRETGSSKGFGFVDFNSEEDAKAAKEAMEDGEIDGNKVTLDWAKPKGEGGFGGRGGGRGGFGGRGGGRGGRGGFGGRGRGGFGGRGGFRGGRGGGGDHKPQGKKTKFE

SEQ ID NO: 7467 - protein, 294 aa, Homo sapiens
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKSIRDTPAKNAQKSNQNGKDSKPSSTPRSKGQESFKKQEKTPKTPKGPSSVEDIKAKMQASIEKGGSLPKVEAKFINYVKNCFRMTDQEAIQDLWQWRKSL

SEQ ID NO: 7468 - protein, 265 aa, Homo sapiens
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKGQESFKKQEKTPKTPKGPSSVEDIKAKMQASIEKGGSLPKVEAKFINYVKNCFRMTDQEAIQDLWQWRKSL

SEQ ID NO: 7469 - protein, 259 aa, Homo sapiens
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKSIRDTPAKNAQKSNQNGKDSKPSSTPRSKGQESFKKQEKTPKTPKGPSSVEDIKAKMQASIEKAH

SEQ ID NO: 7470 - protein, 294 aa, Homo sapiens; identical to SEQ ID NO: 7467

SEQ ID NO: 7471 - protein, 953 aa, Homo sapiens
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEICLNGNLIKPEEAKVYEDEKRIICF

SEQ ID NO: 7472 - protein, 60 aa, Homo sapiens
MEEQGHSEMEIIPSESHPHIQLLKSNRELLVTHIRNTQCLVDNLLKNDYFSAEDAEIVCA

SEQ ID NO: 7473 - protein, 60 aa, Homo sapiens; identical to SEQ ID NO: 7472

SEQ ID NO: 7474 - protein, 45 aa, Homo sapiens
MEEQGHSEMEIIPSESHPHIQLLKSNRELLVTHIRNTQCLVDNLL

SEQ ID NO: 7475 - protein, 60 aa, Homo sapiens; identical to SEQ ID NO: 7472

SEQ ID NO: 7476 - protein, 249 aa, Homo sapiens
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQAASRKVTGCVCRTCSSSTTATQSGTPRRCLPSCCASPTWPSSPSMAWTSCTRTWT

SEQ ID NO: 7477 - protein, 779 aa, Homo sapiens
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLWKSVDTICFKKQGLLK

SEQ ID NO: 7478 - protein, 164 aa, Homo sapiens
MKCKPNQTRTYDPEGFKKRAACLCFRSEREDEVLLVSSSRYPDRWIVPGGGMEPEEEPGGAAVREVYEEAGVKGKLGRLLGVFEQNQDRKHRTYVYVLTVTELLEDWEDSVSIGRKREWFKVEDAIKVLQCHKPVHAEYLEKLKLGGSPTNGNSMAPSSPDSDP

SEQ ID NO: 7479 - protein, 263 aa, Homo sapiens
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQIQVNLRELETAAWFSHDEVATALKRKGPYTQQQNGTFPFWLPPKLAISHQLIKEWVEKQTCSSLPA

SEQ ID NO: 7480 - protein, 352 aa, Homo sapiens
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQMAPVAITLVSDGTRCLLARQSSFPKGMYSALAGFCDIGESVEETIRREVAEEVGLEVESLQYYASQHWPFPSGSLMIACHATVKPGQTEIQVNLRELETAAWFSHDEVATALKRKGPYTQQQNGTFPFWLPPKLAISHQLIKEWVEKQTCSSLPA

SEQ ID NO: 7481 - protein, 235 aa, Homo sapiens
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQVKVWKRPSAEKLQKRWDWRWKACSTMHPSIGPSLVAHS

SEQ ID NO: 7482 - protein, 155 aa, Homo sapiens
MAPVAITLVSDGTRCLLARQSSFPKGMYSALAGFCDIGESVEETIRREVAEEVGLEVESLQYYASQHWPFPSGSLMIACHATVKPGQTEIQVNLRELETAAWFSHDEVATALKRKGPYTQQQNGTFPFWLPPKLAISHQLIKEWVEKQTCSSLPA

SEQ ID NO: 7483 - protein, 226 aa, Homo sapiens
METELKGSFIELRKALFQLNARDASLLSTAQALLRWHDAHQFCSRSGQPTKKNVAGSKRVCPSNNIIYYPQMAPVAITLVSDGTRCLLARQSSFPKGMYSALAGFCDIGESVEETIRREVAEEVGLEVESLQYYASQHWPFPSGSLMIACHATVKPGQTEIQVNLRELETAAWFSHDEVATALKRKGPYTQQQNGTFPFWLPPKLAISHQLIKEWVEKQTCSSLPA

SEQ ID NO: 7484 - protein, 238 aa, Homo sapiens
MLGQPAPLERFASRRPQVLAVRTVCDLVLGKMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVPILIPCHRVVCSSGAVGNYSGGLAVKEWLLAHEGHRLGKPGLGGSSGLAGAWLKGAGATSGSPPAGRN

SEQ ID NO: 7485 - protein, 522 aa, Homo sapiens
MSSRPLESPPPYRPDEFKPNHYAPSNDIYGGEMHVRPMLSQPAYSFYPEDEILHFYKWTSPPGVIRILSMLIIVMCIAIFACVASTLAWDRGYGTSLLGGSVGYPYGGSGFGSYGSGYGYGYGYGYGYGGYTDPRAAKGFMLAMAAFCFIAALVIFVTSVIRSEMSRTRRYYLSVIIVSAILGIMVFIATIVYIMGVNPTAQSSGSLYGSQIYALCNQFYTPAATGLYVDQYLYHYCVVDPQEAIAIVLGFMIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 7486 - protein, 468 aa, Homo sapiens
MSSRPLESPPPYRPDEFKPNHYAPSNDIYGGEMHVRPMLSQPAYSFYPEDEILHFYKWTSPPGVIRILSMLIIVMCIAIFACVASTLAWDRGYGTSLLGGSVGYPYGGSGFGSYGSGYGYGYGYGYGYGGYTDPRAAKGFMLAMAAFCFIAALVIFVTSVIRSEMSRTRRYYLSVIIVSAILGIMVFIATIVYIMGVNPTAQSSGSLYGSQIYALCNQFYTPAATGLYVDQYLYHYCVVDPQEVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 7487 - protein, 522 aa, Homo sapiens; identical to SEQ ID NO: 7485

SEQ ID NO: 7488 - protein, 271 aa, Homo sapiens
MIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 7489 - protein, 200 aa, Homo sapiens
MAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 7490 - protein, 368 aa, Homo sapiens
MQPGSSRCEEETPSLLWGLDPVFLAFAKLYIRDILDMKESRQVPGVFLYNGHPIKQVDVLGTVIGVRERDAFYSYGVDDSTGVINCICWKKLNTESVSAAPSAARELSLTSQLKKLQETIEQKTKIEIGDTIRVRGSIRTYREEREIHATTYYKVDDPVWNIQIARMLELPTIYRKVYDQPFHSSALEKEEALSNPGALDLPSLTSLLSEKAKEFLMENRVQSFYQQELEMVESLLSLANQPVIHSASSDQVNFKKDTTSKAIHSIFKNAIQLLQEKGLVFQKDDGFDNLYYVTREDKDLHRKIHRIIQQDCQKPNHMEKGCHFLHILACARLSIRPGLSEAVLQQVLELLEDQSDIVSTMEHYYTAF

SEQ ID NO: 7491 - protein, 368 aa, Homo sapiens; identical to SEQ ID NO: 7490

SEQ ID NO: 7492 - protein, 345 aa, Homo sapiens
MGVCGYLFLPWKCLVVVSLRLLFLVPTGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 7493 - protein, 312 aa, Homo sapiens
MYHPAYWVVFSATTALLFIPGVPVRSGDATFPKAMDNVTVRQGESATLRCTIDDRVTRVAWLNRSTIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 7494 - protein, 338 aa, Homo sapiens
MYHPAYWVVFSATTALLFIPGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYGPGAVIDGVNSASRALACLWLSGTLLAHFFIKF

SEQ ID NO: 7495 - protein, 354 aa, Homo sapiens
MGVCGYLFLPWKCLVVVSLRLLFLVPTGVPVRSGDATFPKAMDNVTVRQGESATLRCTIDDRVTRVAWLNRSTILYAGNDKWSIDPRVIILVNTPTQYSIMIQNVDVYDEGPYTCSVQTDNHPKTSRVHLIVQVPPQIMNISSDITVNEGSSVTLLCLAIGRPEPTVTWRHLSVKEGQGFVSEDEYLEISDIKRDQSGEYECSALNDVAAPDVRKVKITVNYPPYISKAKNTGVSVGQKGILSCEASAVPMAEFQWFKEETRLATGLDGMRIENKGRMSTLTFFNVSEKDYGNYTCVATNKLGNTNASITLYEISPSSAVAGPGAVIDGVNSASRALACLWLSGTLLAHFFIKF

SEQ ID NO: 7496 - protein, 553 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQVRKLRFQVFSNFSMIAASIPEDCQAPLQPHSTDCCS

SEQ ID NO: 7497 - protein, 545 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQHQFLKIAKPLSSLTPLIAAAKEATKNNH

SEQ ID NO: 7498 - protein, 99 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGM

SEQ ID NO: 7499 - protein, 26 aa, Homo sapiens
MSNNGLDIQDKPPAPPMRNTSTMIGA

SEQ ID NO: 7500 - protein, 89 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGF

SEQ ID NO: 7501 - protein, 63 aa, Homo sapiens
MSNNGLDIQDKPPAPPMRNTSTMIGAGSKDAGTLNHGSKPLPPNPEEKKKKDRFYRSILPGDK

SEQ ID NO: 7502 - protein, 106 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARL

SEQ ID NO: 7503 - protein, 522 aa, Homo sapiens
MSNNGLDIQDKPPAPPMRNTSTMIGAGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLEMDVEKRGSAKELLQHSSRL

SEQ ID NO: 7504 - protein, 438 aa, Homo sapiens
MFGKRKKRVEISAPSNFEHRVHTGFDQHEQKFTGLPRQWQSLIEESARRPKPLVDPACITSIQPGAPKGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 7505 - protein, 591 aa, Homo sapiens
MFGKRKKRVEISAPSNFEHRVHTGFDQHEQKFTGLPRQWQSLIEESARRPKPLVDPACITSIQPGAPKTIVRGSKGAKDGALTLLLDEFENMSVTRSNSLRRDSPPPPARARQENGMPEEPATTARGGPGKAGSRGRFAGHSEAGGGSGDRRRAGPEKRPKSSREGSGGPQESSRDKRPLSGPDVGTPQPAGLASGAKLAAGRPFNTYPRADTDHPSRGAQGEPHDVAPNGPSAGGLAIPQSSSSSSRPPTRARGAPSPGVLGPHASEPQLAPPACTPAAPAVPGPPGPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 7506 - protein, 395 aa, Homo sapiens [sequence omitted]

SEQ ID NO: 7507 - protein, 591 aa, Homo sapiens; identical to SEQ ID NO: 7505

SEQ ID NO: 7508 - protein, 591 aa, Homo sapiens; identical to SEQ ID NO: 7505

SEQ ID NO: 7509 - protein, 347 aa, Homo sapiens
MTWPLTGHQRGAWPSPSPPPPPPGLPPEPEVPPALECWDPTPQSPRSPQREPQRVSHEQFRAALQLVVDPGDPRSYLDNFIKIGEGSTGIVCIATVRSSGKLVAVKKMDLRKQQRRELLFNEVVIMRDYQHENVVEMYNSYLVGDELWVVMEFLEGGALTDIVTHTRMNEEQIAAVCLAVLQALSVLHAQGVIHRDIKSDSILLTHDGRVKLSDFGFCAQVSKEVPRRKSLVGTPYWMAPELISRLPYGPEVDIWSLGIMVIEMVDGEPPYFNEPPLKAMKMIRDNLPPRLKNLHKVSPSLKGFLDRLLVRDPAQRATAAELLKHPFLAKAGPPASIVPLMRQNRTR

SEQ ID NO: 7510 - protein, 591 aa, Homo sapiens; identical to SEQ ID NO: 7505

SEQ ID NO: 7511 - protein, 438 aa, Homo sapiens; identical to SEQ ID NO: 7504

SEQ ID NO: 7512 - protein, 485 aa, Homo sapiens
MAPTIQTQAQREDGHRSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSVMLILRTMPTLMMRTEDRPKVAVTMIQTAAAMGVASGAGATAAAPVPSPVAASTRPRRMAVKLQLLIPVKLIVTVTESQGIQGWFRHHYCEQQSTFLVVCL

SEQ ID NO: 7513 - protein, 531 aa, Homo sapiens
MAPTIQTQAQREDGHRPNSHRTLPERSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSDEEQEKGSSSEKEGSEDEHSGSESEREEGDRDEASDKSGSGEDESSEDEARAARDKEEIFGSDADSEDDADSDDEDRGQAQGGSDNDSDSGSNGGGQRSRSHSRSASPFPSGSEHSAQEDGSEAAASDSSEADSDSD

SEQ ID NO: 7514 - protein, 462 aa, Homo sapiens
MAPTIQTQAQREDGHRSGVVCRVKYCNSLPDIPFDPKFITYPFDQNRFVQYKATSLEKQHKHDLLTEPDLGVTIDLINPDTYRIDPNVLLDPADEKLLEEEIQAPTSSKRSQQHAKVVPWMRKTEYISTEFNRYGISNEKPEVKIGVSVKQQFTEEEIYKDRDSQITAIEKTFEDAQKSMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETRVRLSKRRAKAGVQSGTNALLVVKHRDMNEKELEAQEARKAQLENHEPEEEEEEEMETEEKEAGGSVMLILRTMPTLMMRTEDRPKVAVTMIQTAAAMGVASGAGATAAAPVPSPVAASTRPRRMAVKLQLLIPVKLIVTVTESQGIQGWFRHHYCEQQSTFLVVCL

SEQ ID NO: 7515 - protein, 288 aa, Homo sapiens
MATGPIPTGLCLRGLEWSAESSTAIASLISPSTPSSSPTPSTRTVLLDPADEKLLEEEIQAPTSSKRSQQHAKVVPWMRKTEYISTEFNRYGISNEKPEVKIGVSVKQQFTEEEIYKDRDSQITAIEKTFEDAQKSISQHYSKPRVTPVEVMPVFPDFKMWINPCAQVIFDSDPAPKDTSGAAALEMMSQAMIRGMMDEEGNQFVAYFLPVEETLKKRKRDQEEEMDYAPDDVYDYKIAREYNWNVKNKASKGYEENYFFIFREGDGVYYNELETSIQYSHMLYNLVA

SEQ ID NO: 7516 - protein, 391 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 7517 - protein, 288 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQAVTWRARPSPGTLHTSPPLDRAATQHRR

SEQ ID NO: 7518 - protein, 328 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSPYYYSAAARGAAPPAAATAYDRH

SEQ ID NO: 7519 - protein, 302 aa, Homo sapiens
MFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQWCPVLMRQYLVQPQAVLFQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 7520 - protein, 357 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSEFSGSPYSHPQYSSYNDSWRFPNPGLLGSPYYYSAAARGAAPPAAATAYDRH

SEQ ID NO: 7521 - protein, 362 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSPYYYSAAARGAAPPAAATAYDRH

SEQ ID NO: 7522 - protein, 348 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 7523 - protein, 291 aa, Homo sapiens
MDLEKNYPTPRTSRTGHGGVNQLGGVFVNGRPLPDVVRQRIVELAHQGVRPCDISRQLRVSHGCVSKILGRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGSEFSGSPYSHPQYSSYNDSWRFPNPGLLGSPYYYSAAARGAAPPAAATAYDRH

SEQ ID NO: 7524 - protein, 319 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSPYYYSAAARGAAPPAAATAYDRH

SEQ ID NO: 7525 - protein, 283 aa, Homo sapiens
MFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 7526 - protein, 307 aa, Homo sapiens
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQWCPVLMRQYLVQPQAVLFQAVTWRARPSPGTLHTSPPLDRAATQHRR

SEQ ID NO: 7527 - protein, 398 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVAAPPFWICSKSAPGSRPSMPFPMLPPCTGSSRARPSSQGERWWGPRCPDTHPTSPPADRAAMPPLPSQAWWQEVNTLAMPMATPPTPPTARPGASPTPAC

SEQ ID NO: 7528 - protein, 321 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGERWWGPRCPDTHPTSPPADRAAMPPLPSQAWWQEVNTLAMPMATPPTPPTARPGASPTPAC

SEQ ID NO: 7529 - protein, 398 aa, Homo sapiens; identical to SEQ ID NO: 7527

SEQ ID NO: 7530 - protein, 287 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQEVNTLAMPMATPPTPPTARPGASPTPAC

SEQ ID NO: 7531 - protein, 450 aa, Homo sapiens
MPHNSIRSGHGGLNQLGGAFVNGRPLPEVVRQRIVDLAHQGVRPCDISRQLRVSHGCVSKILGRYYETGSIRPGVIGGSKPKVATPKVVEKIGDYKRQNPTMFAWEIRDRLLAEGVCDNDTVPSVSSINRIIRTKVQQPFNLPMDSCVATKSLSPGHTLIPSSAVTPPESPQSDSLGSTYSINGLLGIAQPGSDKRKMDDSDQDSCRLSIDSQSSSSGPRKHLRTDAFSQHHLEPLECPFERQHYPEAYASPSHTKGEQGLYPLPLLNSTLDDGKATLTPSNTPLGRNLSTHQTYPVVADPHSPFAIKQETPEVSSSSSTPSSLSSSAFLDLQQVGSGVPPFNAFPHAASVYGQFTGQALLSGREMVGPTLPGYPPHIPTSGQGSYASSAIAGMVAGSEYSGNAYGHTPYSSYSEAWRFPNSSLLSSPYYYSSTSRPSAPPTTATAFDHL

SEQ ID NO: 7532 - protein, 189 aa, Homo sapiens
MASKRALVILAKGAEEMETVIPVDVMRRAGIKVTVAGLAGKDPVQCSRDVVICPDASLEDAKKEGPYDVVVLPGGNLGAQNLSESAAVKEILKEQENRKGLIAAICAGPTALLAHEIGFGSKVTTHPLAKDKMMNGGHYTYSENRVEKDGLILTSRGPGTSFEFALAIVEALNGKEVAAQVKAPLVLKD

SEQ ID NO: 7533 - protein, 189 aa, Homo sapiens; identical to SEQ ID NO: 7532

SEQ ID NO: 7534 - protein, 189 aa, Homo sapiens; identical to SEQ ID NO: 7532

SEQ ID NO: 7535 - protein, 189 aa, Homo sapiens; identical to SEQ ID NO: 7532

SEQ ID NO: 7536 - protein, 1186 aa, Homo sapiens [sequence omitted]

SEQ ID NO: 7537 - protein, 1447 aa, Homo sapiens
MASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 7538 - protein, 352 aa, Homo sapiens
KAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISV

SEQ ID NO: 7539 - protein, 1446 aa, Homo sapiens
MELLNRNRLVIVSPRCTPPKASGGPARRGFYTFRSFCKDGGGGEEEEENGGEEKDDRGDKETRSDKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 7540 - protein, 585 aa, Homo sapiens
PCRKSSALNSPKAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIV

SEQ ID NO: 7541 - protein, 242 aa, Homo sapiens
MPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPTCLSTSGVRGGIRRWKSLSCRTWNARRGPGEAAPTEGD

SEQ ID NO: 7542 - protein, 486 aa, Homo sapiens
GKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQYILMAHRGRLSFNDTLWCGGLKSYMRFPYEE

SEQ ID NO: 7543 - protein, 1296 aa, Homo sapiens
MFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 7544 - protein, 1296 aa, Homo sapiens; identical to SEQ ID NO: 7543

SEQ ID NO: 7545 - protein, 1296 aa, Homo sapiens; identical to SEQ ID NO: 7543

SEQ ID NO: 7546 - protein, 1381 aa, Homo sapiens
MGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 7547 - protein, 1381 aa, Homo sapiens; identical to SEQ ID NO: 7546

SEQ ID NO: 7548 - protein, 84 aa, Homo sapiens
MGKATGRKAPLWLRAKFQRLLFKLGCYIQKNCGKFLVVGLLIFGAFAVGLKAANLETNVEELWVEEVNLLCGGQTSTLWNSWKS

SEQ ID NO: 7549 - protein, 174 aa, Homo sapiens
MFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNG

SEQ ID NO: 7550 - protein, 174 aa, Homo sapiens; identical to SEQ ID NO: 7549

SEQ ID NO: 7551 - protein, 92 aa, Homo sapiens
MFNPQLMIQTPKEEGANVLTTEALLQHLDSALQASRVHVYMYNRQWKLEHLCYKSGELITETGYMDQIIEYLYPCLIITPLDCFWEGAKLQS

SEQ ID NO: 7552 - protein, 174 aa, Homo sapiens; identical to SEQ ID NO: 7549

SEQ ID NO: 7553 - protein, 174 aa, Homo sapiens; identical to SEQ ID NO: 7549

SEQ ID NO: 7554 - protein, 591 aa, Homo sapiens
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKIQGLEQRADGERCWAAGWPRDGGRSSPGGQDEGGFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 7555 - protein, 605 aa, Homo sapiens
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKGSWPLEEVVLLVSISSSVQEGEKYPHPCAARHRTPSLRSPDQPPPCPQFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 7556 - protein, 233 aa, Homo sapiens [sequence omitted]

SEQ ID NO: 7557 - protein, 403 aa, Homo sapiens
MSAPSSTGPQYCPGLPSRKEATPEGRPETCLLPSSPQAQRPIQGLEQRADGERCWAAGWPRDGGRSSPGGQDEGGGSWPLEEVVLLVSISSSVQEGEKYPHPCAARHRTPSLRSPDQPPPCPQFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 7558 - protein, 557 aa, Homo sapiens
MDDLDALLADLESTTSHISKRPVFLSEETPYSYPTGNHTYQEIAVPPPVPPPPSSEALNGTILDPLDQWQPSSSRFIHQQPQSSSPVYGSSAKTSSVSNPQDSVGSPCSRVGEEEHVYSFPNKQKSAEPSPTVMSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 7559 - protein, 424 aa, Homo sapiens
MSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRECFTPFVNGSFFEHDGQPYCEVHYHERRGSLCSGCQKPITGRCITAMAKKFHPEHFVCAFCLKQLNKGTFKEQNDKPYCQNCFLKLFC

SEQ ID NO: 7560 - protein, 316 aa, Homo sapiens [sequence omitted]

SEQ ID NO: 7561 - protein, 330 aa, Homo sapiens
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGDWPGPGGPRNLKPTASKLGAPLSGLQGLPECTRCGHGIVGTIVKARDKLYHPECFMCSDCGLNLKQRGYFFLDERLYCESHAKARVKPPEGYDVVAVYPNAKVELV

SEQ ID NO: 7562 - protein, 246 aa, Homo sapiens
MPHSVTLRGPSPWGFRLVGGRDFSAPLTISRVHAGSKAALAALCPGDLIQAINGESTELMTHLEAQNRIKGCHDHLTLSVSRPEGRSWPSAPDDSKAQAHRIHIDPEIQDGSPTTSRRPSGTGTGPEDGRPSLGSPYGQPPRFPVPHNGSSEATLPAQMSTLHVSPPPSADPARGLPRSRDCRVDLGSEVYRMLREPAEPVAAEPKQSGSFRYLQGMLEAGEGGAPSSRHGTSSTIPSASCAVTAA

SEQ ID NO: 7563 - protein, 596 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 7564 - protein, 214 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKKTQVTNNPGTVKIPPKRPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 7565 - protein, 234 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGKIPPKRPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 7566 - protein, 487 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 7567 - protein, 234 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGPVPRKIPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 7568 - protein, 214 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKVTQKRESRSSRRTAPGLPPRKHIVERYTEFYHVPTHSDASKKRLIEDTEDWRPRTGTTQSRSFRILAQITGTEHLKESEADNTKKAKEKIPLHVFSPKYTKLRDWHHEVSARALNVQ

SEQ ID NO: 7569 - protein, 474 aa, Homo sapiens
MAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 7570 - protein, 136 aa, Homo sapiens
MSNYSVSLVGPAPWGFRLQGGKDFNMPLTISSAGVQWRNLGSPQPPSPEFKRFSCLSLPSSWDYRHVPPRLANFVFLVETKFPYVGQAGLELPTSGDLPTSASQSAKITGVSHRAWPTLFYTLLFFATIYPEIILY

SEQ ID NO: 7571 - protein, 222 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSREKYVLELQSPRYTRLRDWHHQRSAHVLNVQS

SEQ ID NO: 7572 - protein, 457 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 7573 - protein, 287 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSRPYRPQPYQPPALGCGPCVCRALCPGQNEHSADPAQPAGHAHAAAEPHLHCAGSCRRGARRGQQQRQDSRVSPVPQGHPGPLPGGAGPRVPPGGVCV

SEQ ID NO: 7574 - protein, 423 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKVQTPDKQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 7575 - protein, 173 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHL

SEQ ID NO: 7576 - protein, 90 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSK

SEQ ID NO: 7577 - protein, 163 aa, Homo sapiens
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 7578 - protein, 45 aa, Homo sapiens
MQKPFEDASFALRTGEMSGPVFTDSGIHIILRTECWRQTRGPNCF

SEQ ID NO: 7579 - protein, 145 aa, Homo sapiens
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGAQGMGLTRLGDPYHPEG

SEQ ID NO: 7580 - protein, 186 aa, Homo sapiens
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNEELQKDSY

SEQ ID NO: 7581 - protein, 583 aa, Homo sapiens
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 7582 - protein, 588 aa, Homo sapiens
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 7583 - protein, 449 aa, Homo sapiens
MCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEMSAQEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 7584 - protein, 449 aa, Homo sapiens; identical to SEQ ID NO: 7583

SEQ ID NO: 7585 - protein, 1717 aa, Homo sapiens
MEPAAAATVQRLPELGREDRASAPAAAAAAAAAAAAAAAALAAAAGGGRSPEPALTPAAPSGGNGSGSGAREEAPGEAPPGPLPGRAGGAGRRRRRGAPQPIAGGAAPVPGAGGGANSLLLRRGRLKRNLSAAAAAASSSSSSSAAAASHSPGAAGLPASCSASASLCTRSLDRKTLLLKHRQTLQLQPSDRDWVRHQLQRGCVHVFDRHMASTYLRPVLCTLDTTAGEVAARLLQLGHKGGGVVKVLGQGPGAAAAREPAEPPPEAGPRLAPPEPRDSEVPPARSAPGAFGGPPRAPPADLPLPVGGPGGWSRRASPAPSDSSPGEPFVGGPVSSPRAPRPVVSDTESFSLSPSAESVSDRLDPYSSGGGSSSSSEELEADAASAPTGVPGQPRRPGHPAQPLPLPQTASSPQPQQKAPRAIDSPGGAVREGSCEEKAAAAVAPGGLQSTPGRSGVTAEKAPPPPPPPTLYVQLHGETTRRLEAEEKPLQIQNDYLFQLGFGELWRVQEEGMDSEIGCLIRFYAGKPHSTGSSERIQLSGMYNVRKGKMQLPVNRWTRRQVILCGTCLIVSSVKDSLTGKMHVLPLIGGKVEEVKKHQHCLAFSSSGPQSQTYYICFDTFTEYLRWLRQVSKVASQRISSVDLSCCSLEHLPANLFYSQDLTHLNLKQNFLRQNPSLPAARGLNELQRFTKLKSLNLSNNHLGDFPLAVCSIPTLAELNVSCNALRSVPAAVGVMHNLQTFLLDGNFLQSLPAELENMKQLSYLGLSFNEFTDIPEVLEKLTAVDKLCMSGNCVETLRLQALRKMPHIKHVDLRLNVIRKLIADEVDFLQHVTQLDLRDNKLGDLDAMIFNNIEVLHCERNQLVTLDICGYFLKALYASSNELVQLDVYPVPNYLSYMDVSRNRLENVPEWVCESRKLEVLDIGHNQICELPARLFCNSSLRKLLAGHNQLARLPERLERTSVEVLDVQHNQLLELPPNLLMKADSLRFLNASANKLESLPPATLSEETNSILQELYLTNNSLTDKCVPLLTGHPHLKILHMAYNRLQSFPASKMAKLEELEEIDLSGNKLKAIPTTIMNCRRMHTVIAHSNCIEVFPEVMQLPEIKCVDLSCNELSEVTLPENLPPKLQELDLTGNPRLVLDHKTLELLNNIRCFKIDQPSTGDASGAPAVWSHGYTEASGVKNKLCVAALSVNNFCDNREALYGVFDGDRNVEVPYLLQCTMSDILAEELQKTKNEEEYMVNTFIVMQRKLGTAGQKLGGAAVLCHIKHDPVDPGGSFTLTSANVGKCQTVLCRNGKPLPLSRSYIMSCEEELKRIKQHKAIITEDGKVNGVTESTRILGYTFLHPSVVPRPHVQSVLLTPQDEFFILGSKGLWDSLSVEEAVEAVRNVPDALAAAKKLCTLAQSYGCHDSISAVVVQLSVTEDSFCCCELSAGGAVPPPSPGIFPPSVNMVIKDRPSDGLGVPSSSSGMASEISSELSTSEMSSEVGSTASDEPPPGALSENSPAYPSEQRCMLHPICLSNSFQRQLSSATFSSAFSDNGLDSDDEEPIEGVFTNGSRVEVEVDIHCSRAKEKEKQQHLLQVPAEASDEGIVISANEDEPGLPRKADFSAVGTIGRRRANGSVAPQERSHNVIEVATDAPLRKPGGYFAAPAQPDPDDQFIIPPELEEEVKEIMKHHQEQQQQQQPPPPPQLQPQLPRHYQLDQLPDYYDTPL

SEQ ID NO: 7586 - protein, 1205 aa, Homo sapiens
MDSEIGCLIRFYAGKPHSTGSSERIQLSGMYNVRKGKMQLPVNRWTRRQVILCGTCLIVSSVKDSLTGKMHVLPLIGGKVEEVKKHQHCLAFSSSGPQSQTYYICFDTFTEYLRWLRQVSKVASQRISSVDLSCCSLEHLPANLFYSQDLTHLNLKQNFLRQNPSLPAARGLNELQRFTKLKSLNLSNNHLGDFPLAVCSIPTLAELNVSCNALRSVPAAVGVMHNLQTFLLDGNFLQSLPAELENMKQLSYLGLSFNEFTDIPEVLEKLTAVDKLCMSGNCVETLRLQALRKMPHIKHVDLRLNVIRKLIADEVDFLQHVTQLDLRDNKLGDLDAMIFNNIEVLHCERNQLVTLDICGYFLKALYASSNELVQLDVYPVPNYLSYMDVSRNRLENVPEWVCESRKLEVLDIGHNQICELPARLFCNSSLRKLLAGHNQLARLPERLERTSVEVLDVQHNQLLELPPNLLMKADSLRFLNASANKLESLPPATLSEETNSILQELYLTNNSLTDKCVPLLTGHPHLKILHMAYNRLQSFPASKMAKLEELEEIDLSGNKLKAIPTTIMNCRRMHTVIAHSNCIEVFPEVMQLPEIKCVDLSCNELSEVTLPENLPPKLQELDLTGNPRLVLDHKTLELLNNIRCFKIDQPSTGDASGAPAVWSHGYTEASGVKNKLCVAALSVNNFCDNREALYGVFDGDRNVEVPYLLQCTMSDILAEELQKTKNEEEYMVNTFIVMQRKLGTAGQKLGGAAVLCHIKHDPVDPGGSFTLTSANVGKCQTVLCRNGKPLPLSRSYIMSCEEELKRIKQHKAIITEDGKVNGVTESTRILGYTFLHPSVVPRPHVQSVLLTPQDEFFILGSKGLWDSLSVEEAVEAVRNVPDALAAAKKLCTLAQSYGCHDSISAVVVQLSVTEDSFCCCELSAGGAVPPPSPGIFPPSVNMVIKDRPSDGLGVPSSSSGMASEISSELSTSEMSSEVGSTASDEPPPGALSENSPAYPSEQRCMLHPICLSNSFQRQLSSATFSSAFSDNGLDSDDEEPIEGVFTNGSRVEVEVDIHCSRAKEKEKQQHLLQVPAEASDEGIVISANEDEPGLPRKADFSAVGTIGRRRANGSVAPQERSHNVIEVATDAPLRKPGGYFAAPAQPDPDDQFIIPPELEEEVKEIMKHHQEQQQQQQPPPPPQLQPQLPRHYQLDQLPDYYDTPL

SEQ ID NO: 7587 - protein, 792 aa, Homo sapiens
MHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLRMNHLKTMVIENLEGNKHITHVDLRDNRLTDLDLSSLCSLEQLHCGRNQLRELTLSGFSLRTLYASSNRLTAVNVYPVPSLLTFLDLSRNLLECVPDWACEAKKIEVLDVSYNLLTEVPVRILSSLSLRKLMLGHNHVQNLPTLVEHIPLEVLDLQHNALTRLPDTLFSKALNLRYLNASANSLESLPSACTGEESLSMLQLLYLTNNLLTDQCIPVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITEVPEDLKEFQTTDIPVHHCNFRAVLGCLCSASVLGSYAGPAPRWRRT

SEQ ID NO: 7588 - protein, 1323 aa, Homo sapiens
MKRNGSRNCLNRRSRFGSRERDWLREDVKRGCVYLYGADTTTATTTTTTSSSSSSSSSSSDLHLVLCTVETPASEICAGEGRESLYLQLHGDLVRRLEPTERPLQIVYDYLSRLGFDDPVRIQEEATNPDLGCMIRFYGEKPCHMDRLDRILLSGIYNVRKGKTQLHKWAERLVVLCGTCLIVSSVKDCQTGKMHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLRMNHLKTMVIENLEGNKHITHVDLRDNRLTDLDLSSLCSLEQLHCGRNQLRELTLSGFSLRTLYASSNRLTAVNVYPVPSLLTFLDLSRNLLECVPDWACEAKKIEVLDVSYNLLTEVPVRILSSLSLRKLMLGHNHVQNLPTLVEHIPLEVLDLQHNALTRLPDTLFSKALNLRYLNASANSLESLPSACTGEESLSMLQLLYLTNNLLTDQCIPVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITEDNKVNGVTCCTRMLGCTYLYPWILPKPHISSTPLTIQDELLILGNKALWEHLSYTEAVNAVRHVQDPLAAAKKLCTLAQSYGCQDNVGAMVVYLNIGEEGCTCEMNGLTLPGPVGFASTTTIKDAPKPATPSSSSGIASEFSSEMSTSEVSSEVGSTASDEHNAGGLDTALLPRPERRCSLHPTPTSGLFQRQPSSATFSSNQSDNGLDSDDDQPVEGVITNGSKVEVEVDIHCCRGRDLENSPPLIESSPTLCSEEHARGSCFGIRRQNSVNSGMLLPMSKDRMELQKSPSTSCLYGKKLSNGSIVPLEDSLNLIEVATEVPKRKTGYFAAPTQMEPEDQFVVPHDLEEEVKEQMKQHQDSRLEPEPHEEDRTEPPEEFDTAL

SEQ ID NO: 7589 - protein, 956 aa, Homo sapiens
MKRNGSRNCLNRRSRFGSRERDWLREDVKRGCVYLYGADTTTATTTTTTSSSSSSSSSSSDLHLVLCTVETPASEICAGEGRESLYLQLHGDLVRRLEPTERPLQIVYDYLSRLGFDDPVRIQEEATNPDLGCMIRFYGEKPCHMDRLDRILLSGIYNVRKGKTQLHKWAERLVVLCGTCLIVSSVKDCQTGKMHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLRMNHLKTMVIENLEGNKHITHVDLRDNRLTDLDLSSLCSLEQLHCGRNQLRELTLSGFSLRTLYASSNRLTAVNVYPVPSLLTFLDLSRNLLECVPDWACEAKKIEVLDVSYNLLTEVPVRILSSLSLRKLMLGHNHVQNLPTLVEHIPLEVLDLQHNALTRLPDTLFSKALNLRYLNASANSLESLPSACTGEESLSMLQLLYLTNNLLTDQCIPVLVGHLHLRILHLANNQLQTFPASKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITENWVLNQKHLQDFPGEDK

SEQ ID NO: 7590 - protein, 1256 aa, Homo sapiens
MKRNGSRNCLNRRSRFGSRERDWLREDVKRGCVYLYGADTTTATTTTTTSSSSSSSSSSSDLHLVLCTVETPASEICAGEGRESLYLQLHGDLVRRLEPTERPLQIVYDYLSRLGFDDPVRIQEEATNPDLGCMIRFYGEKPCHMDRLDRILLSGIYNVRKGKTQLHKWAERLVVLCGTCLIVSSVKDCQTGKMHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLRMNHLKTMVIENLEGNKHITHVDLRDNRLTDLDLSSLCSLEQLHCGRNQLRELTLSGFSLRTLYASSNRLTAVNVYPVPSLLTFLDLSRNLLECVPDWACEAKKIEVLDVSYNLLTEVPVRILSSLSLRKLMLGHNHVQNLPTLVEHIPLEVLDLQHNALTRLPDTLFSKALNKLNKLEQLEELNLSGNKLKTIPTTIANCKRLHTLVAHSNNISIFPEILQLPQIQFVDLSCNDLTEILIPEALPATLQDLDLTGNTNLVLEHKTLDIFSHITTLKIDQKPLPTTDSTVTSTFWSHGLAEMAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITEDNKVNGVTCCTRMLGCTYLYPWILPKPHISSTPLTIQDELLILGNKALWEHLSYTEAVNAVRHVQDPLAAAKKLCTLAQSYGCQDNVGAMVVYLNIGEEGCTCEMNGLTLPGPVGFASTTTIKDAPKPATPSSSSGIASEFSSEMSTSEVSSEVGSTASDEHNAGGLDTALLPRPERRCSLHPTPTSGLFQRQPSSATFSSNQSDNGLDSDDDQPVEGVITNGSKVEVEVDIHCCRGRDLENSPPLIESSPTLCSEEHARGSCFGIRRQNSVNSGMLLPMSKDRMELQKSPSTSCLYGKKLSNGSIVPLEDSLNLIEVATEVPKRKTGYFAAPTQMEPEDQFVVPHDLEEEVKEQMKQHQDSRLEPEPHEEDRTEPPEEFDTAL

SEQ ID NO: 7591 - protein, 423 aa, Homo sapiens
MKRNGSRNCLNRRSRFGSRERDWLREDVKRGCVYLYGADTTTATTTTTTSSSSSSSSSSSDLHLVLCTVETPASEICAGEGRESLYLQLHGDLVRRLEPTERPLQIVYDYLSRLGFDDPVRIQEEATNPDLGCMIRFYGEKPCHMDRLDRILLSGIYNVRKGKTQLHKWAERLVVLCGTCLIVSSVKDCQTGKMHILPLVGGKIEEVKRRQYSLAFSSAGAQAQTYHVSFETLAEYQRWQRQASKVVSQRISTVDLSCYSLEEVPEHLFYSQDITYLNLRHNFMQLERPGGLDTLYKFSQLKGLNLSHNKLGLFPILLCEISTLTELNLSCNGFHDLPSQIGNLLNLQTLCLDGNFLTTLPEELGNLQQLSSLGISFNNFSQIPEVYEKLTMLDRVVMAGNCLEVLNLGVLNRMNHIKHVDLR

SEQ ID NO: 7592 - protein, 166 aa, Homo sapiens
MAGQRNKLCVSALAMDSFAEGVGAVYGMFDGDRNEELPRLLQCTMADVLLEEVQQSTNDTVFMANTFLVSHRKLGMAGQKLGSSALLCYIRPDTADPASSFSLTVANVGTCQAVLCRGGKPVPLSKVFSLEQDPEEAQRVKDQKAIITENWVLNQKHLQDFPGEDK

SEQ ID NO: 7593 - protein, 1323 aa, Homo sapiens; identical to SEQ ID NO: 7588

SEQ ID NO: 7594 - protein, 403 aa, Homo sapiens [sequence omitted]

SEQ ID NO: 7595 - protein, 176 aa, Homo sapiens
MGKAAAAVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSCMNIIWTLPYACFHIIEFNLES

SEQ ID NO: 7596 - protein, 216 aa, Homo sapiens
MGKAAAAVAFGAEVGVRLALFAAFLVTELLPPFQRLIQPEEMWLYRNPYVEAEYFPTKPMFVIAFLSPLSLIFLAKFLKKADTRDSRQACLAASLALALNGVFTNTIKLIVGRPRPDFFYRCFPDGLAHSDLMCTGDKDVVNEGRKSFPSGHSSFAFAGLAFASFYLAGKLHCFTPQGRGKSWRFCAFLSPLLFAAVIALSRTCDYKHHWQGPFKW

SEQ ID NO: 7597 - protein, 264 aa, Homo sapiens [sequence omitted]

SEQ ID NO: 7598 - protein, 361 aa, Homo sapiens
MHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 7599 - protein, 1068 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 7600 - protein, 118 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIG

SEQ ID NO: 7601 - protein, 21 aa, Homo sapiens
MPPRPSSGELWGIHLMPPRIL

SEQ ID NO: 7602 - protein, 1070 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 7603 - protein, 100 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLC

SEQ ID NO: 7604 - protein, 56 aa, Homo sapiens
MCFSFIMPPAMADILDIWAVDSQIASDGSIPVDFLLPTGIYIQLEVPREATISYIK

SEQ ID NO: 7605 - protein, 1070 aa, Homo sapiens; identical to SEQ ID NO: 7602

SEQ ID NO: 7606 - protein, 131 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIG

SEQ ID NO: 7607 - protein, 702 aa, Homo sapiens
  MOD_RES (1)..(1): Any amino acid
XVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 7608 - protein, 521 aa, Homo sapiens
MDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDVCFPLDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 7609 - protein, 1068 aa, Homo sapiens
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKLPGGMLLASREWRPELLWMRLHAEDSAPSRMIGVAMPGLGVLPGLVQAPGDAECSRLLQILELGRHSECVHVTEEEQLQLREILERRGSGELYEHEKDLVWKLRHEVQEHFPEALARLLLVTKWNKHEDVAQDALPAVSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 7610 - protein, 1068 aa, Homo sapiens
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKLPGGMLLASREWRPELLWMRLHAEDSAPSRMIGVAMPGLGVLPGLVQAPGDAECSRLLQILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 7611 - protein, 1044 aa, Homo sapiens
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQYICSCLHSGLTPHLTMVHSSSILAMRDEQSNPAPQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 7612 - protein, 1068 aa, Homo sapiens; identical to SEQ ID NO: 7610

SEQ ID NO: 7613 - protein, 319 aa, Homo sapiens
MIPESSELVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLR

SEQ ID NO: 7614 - protein, 1102 aa, Homo sapiens
MELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVQLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 7615 - protein, 1102 aa, Homo sapiens; identical to SEQ ID NO: 7614

SEQ ID NO: 7616 - protein, 1102 aa, Homo sapiens; identical to SEQ ID NO: 7614

SEQ ID NO: 7617 - protein, 1686 aa, Homo sapiens
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQLYFRPTIQRGQWPPGLPGPSTYALPSIYPSTYSKQAAFQNGFNPRMPTFPSTEPIYLSLPGQSPYFSYPLTPATPFHPQGSLPIYRPVVSTDMAKLFDKIASTSEFLKNGKARTDLEITDSKVSNLQVSPKSEDISKFDWLDLDPLSKPKVDNVEVLDHEEEKNVSSLLAKDPWDAVLLEERSTANCHLERKVNGKSLSVATVTRSQSLNIRTTQLAKAQGHISQKDPNGTSSLPTGSSLLQEVEVQNEEMAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQNNHCLGSHEHIQNCRKWDTEIRLQLLTFSAMCQNLARTAEDDETPVDLNKHLYQIEKPCKEAMTRHPVEELLDSYHNQVELALQIENQHRAVDQVIKAVRKICSALDGVETLAITESVKKLKRAVNLPRSKTADVTSLFGGEDTSRSSTRGSLNPENPVQVSINQLTAAIYDLLRLHANSGRSPTDCAQSSKSVKEAWTTTEQLQFTIFAAHGISSNWVSNYEKYYLICSLSHNGKDLFKPIQSKKVGTYKNFFYLIKWDELIIFPIQISQLPLESVLHLTLFGILNQSSGSSPDSNKQRKGPEALGKVSLPLFDFKRFLTCGTKLLYLWTSSHTNSVPGTVTKKGYVMERIVLQVDFPSPAFDIIYTTPQVDRSIIQQHNLETLENDIKGKLLDILHKDSSLGLSKEDKAFLWEKRYYCFKHPNCLPKILASAPNWKWVNLAKTYSLLHQWPALYPLIALELLDSKFADQEVRSLAVTWIEAISDDELTDLLPQFVQALKYEIYLNSSLVQFLLSRALGNIQIAHNLYWLLKDALHDVQFSTRYEHVLGALLSVGGKRLREELLKQTKLVQLLGGVAEKVRQASGSARQVVLQRSMERVQSFFQKNKCRLPLKPSLVAKELNIKSCSFFSSNAVPLKVTMVNADPMGEEINVMFKVGEDLRQDMLALQMIKIMDKIWLKEGLDLRMVIFKCLSTGRDRGMVELVPASDTLRKIQVEYGVTGSFKDKPLAEWLRKYNPSEEEYEKASENFIYSCAGCCVATYVLGICDRHNDNIMLRSTGHMFHIDFGKFLGHAQMFGSFKRDRAPFVLTSDMAYVINGGEKPTIRFQLFVDLCCQAYNLIRKQTNLFLNLLSLMIPSGLPELTSIQDLKYVRDALQPQTTDAEATIFFTRLIESSLGSIATKFNFFIHNLAQLRFSGLPSNDEPILSFSPKTYSFRQDGRIKEVSVFTYHKKYNPDKHYIYVVRILREGQIEPSFVFRTFDEFQELHNKLSIIFPLWKLPGFPNRMVLGRTHIKDVAAKRKIELNSYLQSLMNASTDVAECDLVCTFFHPLLRDEKAEGIARSADAGSFSPTPGQIGGAVKLSISYRNGTLFIMVMHIKDLVTEDGADPNPYVKTYLLPDNHKTSKRKTKISRKTRNPTFNEMLVYSGYSKETLRQRELQLSVLSAESLRENFFLGGVTLPLKDFNLSKETVKWYQLTAATYL

SEQ ID NO: 7618 - protein, 130 aa, Homo sapiens
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQ

SEQ ID NO: 7619 - protein, 483 aa, Homo sapiens
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQLYFRPTIQRGQWPPGLPGPSTYALPSIYPSTYSKQAAFQNGFNPRMPTFPSTEPIYLSLPGQSPYFSYPLTPATPFHPQGSLPIYRPVVSTDMAKLFDKIASTSEFLKNGKARTDLEITDSKVSNLQVSPKSEDISKFDWLDLDPLSKPKVDNVEVLDHEEEKNVSSLLAKDPWDAVLLEERSTANCHLERKVNGKSLSVATVTRSQSLNIRTTQLAKAQGHISQKDPNGTSSLPTGSSLLQEVEVQNEEMAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQK

SEQ ID NO: 7620 - protein, 1306 aa, Homo sapiens
MAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQNNHCLGSHEHIQNCRKWDTEIRLQLLTFSAMCQNLARTAEDDETPVDLNKHLYQIEKPCKEAMTRHPVEELLDSYHNQVELALQIENQHRAVDQVIKAVRKICSALDGVETLAITESVKKLKRAVNLPRSKTADVTSLFGGEDTSRSSTRGSLNPENPVQVSINQLTAAIYDLLRLHANSGRSPTDCAQSSKSVKEAWTTTEQLQFTIFAAHGISSNWVSNYEKYYLICSLSHNGKDLFKPIQSKKVGTYKNFFYLIKWDELIIFPIQISQLPLESVLHLTLFGILNQSSGSSPDSNKQRKGPEALGKVSLPLFDFKRFLTCGTKLLYLWTSSHTNSVPGTVTKKGYVMERIVLQVDFPSPAFDIIYTTPQVDRSIIQQHNLETLENDIKGKLLDILHKDSSLGLSKEDKAFLWEKRYYCFKHPNCLPKILASAPNWKWVNLAKTYSLLHQWPALYPLIALELLDSKFADQEVRSLAVTWIEAISDDELTDLLPQFVQALKYEIYLNSSLVQFLLSRALGNIQIAHNLYWLLKDALHDVQFSTRYEHVLGALLSVGGKRLREELLKQTKLVQLLGGVAEKVRQASGSARQVVLQRSMERVQSFFQKNKCRLPLKPSLVAKELNIKSCSFFSSNAVPLKVTMVNADPMGEEINVMFKVGEDLRQDMLALQMIKIMDKIWLKEGLDLRMVIFKCLSTGRDRGMVELVPASDTLRKIQVEYGVTGSFKDKPLAEWLRKYNPSEEEYEKASENFIYSCAGCCVATYVLGICDRHNDNIMLRSTGHMFHIDFGKFLGHAQMFGSFKRDRAPFVLTSDMAYVINGGEKPTIRFQLFVDLCCQAYNLIRKQTNLFLNLLSLMIPSGLPELTSIQDLKYVRDALQPQTTDAEATIFFTRLIESSLGSIATKFNFFIHNLAQLRFSGLPSNDEPILSFSPKTYSFRQDGRIKEVSVFTYHKKYNPDKHYIYVVRILREGQIEPSFVFRTFDEFQELHNKLSIIFPLWKLPGFPNRMVLGRTHIKDVAAKRKIELNSYLQSLMNASTDVAECDLVCTFFHPLLRDEKAEGIARSADAGSFSPTPGQIGGAVKLSISYRNGTLFIMVMHIKDLVTEDGADPNPYVKTYLLPDNHKTSKRKTKISRKTRNPTFNEMLVYSGYSKETLRQRELQLSVLSAESLRENFFLGGVTLPLKDFNLSKETVKWYQLTAATYL

SEQ ID NO: 7621 - protein, 648 aa, Homo sapiens
MAQISSNSGFKECPSSHPEPTRAKDVDKEEALQMEAEALAKLQKDRQVTDNQRGFELSSSTRKKAQVYNKQDYDLMVFPESDSQKRALDIDVEKLTQAELEKLLLDDSFETKKTPVLPVTPILSPSFSAQLYFRPTIQRGQWPPGLPGPSTYALPSIYPSTYSKQAAFQNGFNPRMPTFPSTEPIYLSLPGQSPYFSYPLTPATPFHPQGSLPIYRPVVSTDMAKLFDKIASTSEFLKNGKARTDLEITDSKVSNLQVSPKSEDISKFDWLDLDPLSKPKVDNVEVLDHEEEKNVSSLLAKDPWDAVLLEERSTANCHLERKVNGKSLSVATVTRSQSLNIRTTQLAKAQGHISQKDPNGTSSLPTGSSLLQEVEVQNEEMAAFCRSITKLKTKFPYTNHRTNPGYLLSPVTAQRNICGENASVKVSIDIEGFQLPVTFTCDVSSTVEIIIMQALCWVHDDLNQVDVGSYVLKVCGQEEVLQNNHCLGSHEHIQNCRKWDTEIRLQLLTFSAMCQNLARTAEDDETPVDLNKHLYQIEKPCKEAMTRHPVEELLDSYHNQVELALQIENQHRAVDQVIKAVRKICSALDGVETLAITESVKKLKRAVNLPRSKTADVTSLFGGEDTSRSSTRGSLNPENPVQVSINQL

SEQ ID NO: 7622 - protein, 887 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGKLFHIDFGYILGRDPKPLPPPMKLNKEMVEGMGGTQSEQYQEFRKQCYTAFLHLRRYSNLILNLFSLMVDANIPDIALEPDKTVKKVQDKFRLDLSDEEAVHYMQSLIDESVHALFAAVVEQIHKFAQYWRK

SEQ ID NO: 7623 - protein, 824 aa, Homo sapiens
MGEAEKFHYIYSCDLDINVQLKIWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKVPDPQMSMENLVESKHHKLARSLRSGPSDHDLKPNAATRDQLNIIVSYPPTKQLTYEEQDLVWKFRYYLTNQEKALTKFLKCVNWDLPQEAKQALELLGKWKPMDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDTQQRDPKTHEMYLNVMRRFSQALLKGDKSVRVMRSLLAAQQTFVDRLVHLMKAVQRESGNRKKKNERLQALLGDNEKMNLSDVELIPLPLEPQVKIRGIIPETATLFKSALMPAQLFFKTEDGGKYPVIFKHGDDLRQDQLILQIISLMDKLLRKENLDLKLTPYKVLATSTKHGFMQFIQSVPVAEVLDTEGSIQNFFRKYAPSENGPNGISAEVMDTYVKSCAGYCVITYILGVGDRHLDNLLLTKTGKLFHIDFGYILGRDPKPLPPPMKLNKEMVEGMGGTQSEQYQEFRKQCYTAFLHLRRYSNLILNLFSLMVDANIPDIALEPDKTVKKVQDKFRLDLSDEEAVHYMQSLIDESVHALFAAVVEQIHKFAQYWRK

SEQ ID NO: 7624 - protein, 724 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 7625 - protein, 424 aa, Homo sapiens
MHNLQTLPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 7626 - protein, 454 aa, Homo sapiens
MYNTVWNMEDLDLEYAKTDINCGTDLMFYIEMDPPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 7627 - protein, 732 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEENFLSCLPSQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 7628 - protein, 724 aa, Homo sapiens; identical to SEQ ID NO: 7624

SEQ ID NO: 7629 - protein, 137 aa, Homo sapiens
MHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQT

SEQ ID NO: 7630 - protein, 724 aa, Homo sapiens; identical to SEQ ID NO: 7624

SEQ ID NO: 7631 - protein, 728 aa, Homo sapiens
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVASRAPALGPAVRALGATFGPLLLRAPPPPSSPPPGGAPDGSEPSPDFPALLVEKLLQEHLEEQEVAPPALPPKPPKAKPASTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 7632 - protein, 461 aa, Homo sapiens
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERIMMNYDKLKSRLGEIHDSKMRLEQDLKNQALDNREIDKKMNSIKPDLIQLRKIRDQHLVWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 7633 - protein, 366 aa, Homo sapiens
MYNTVWSMDRDDADWREVMMPYSTELIFYIEMDPPAAEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 7634 - protein, 402 aa, Homo sapiens
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 7635 - protein, 461 aa, Homo sapiens; identical to SEQ ID NO: 7632

SEQ ID NO: 7636 - protein, 461 aa, Homo sapiens; identical to SEQ ID NO: 7632

SEQ ID NO: 7637 - protein, 402 aa, Homo sapiens; identical to SEQ ID NO: 7634

SEQ ID NO: 7638 - protein, 206 aa, Homo sapiens
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTS

SEQ ID NO: 7639 - protein, 507 aa, Homo sapiens
MGPSRLVRGPRPQGMRSPYRRPGMGWPRPRFPRMFKCSRRRYQQGLRGRTASSAAINPATRAMGINNTHTDTTIVWIFPPQALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERIMMNYDKLKSRLGEIHDSKMRLEQDLKNQALDNREIDKKMNSIKPDLIQLRKIRDQHLVWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 7640 - protein, 880 aa, Homo sapiens
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVTVLLLNPVEVQAEFLAVANKLSTPGHSPHSAYTTLLLHAFQATFGAHCDVPGLHCRLQAKTLAELEDIFTETAEAQELASGIGDAAEARRWLRTKLQAVGEKAGFPGVLDTAKPGKLHTIPIPVARCYTYSWSQDSFDILQEILLKEQELLQPGILGDDEEEEEEEEEVEEDLETDGHCAERDSLLSTSSLASHDSTLSLASSQASGPALSRHLLTSFVSGLSDGMDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRCEVSPCYKPEKSDLSSPPQTPPDLPAQAAPDLCSLLCLPIMTFSGALP

SEQ ID NO: 7641 - protein, 880 aa, Homo sapiens; identical to SEQ ID NO: 7640

SEQ ID NO: 7642 - protein, 148 aa, Homo sapiens
MKLLVLAVLLTVAAADSGISPRAVWQFRKMIKCVIPGSDPFLEYNNYGCYCGLGGSGTPVDELDKCCQTHDNCYDQAKKLDSCKFLLDNPYTHTYSYSCSGSAITCSSKNKECEAFICNCDRNAAICFSKAPYNKAHKNLDTKKYCQS

SEQ ID NO: 7643 - protein, 144 aa, Homo sapiens
MKTLLLLAVIMIFGLLQAHGNLVNFHRMIKLTTGKEAALSYGFYGCHCGVGGRGSPKDATDRCCVTHDCCYKRLEKRGCGTKFLSYKFSNSGSRITCAKQDSCRSQLCECDKAAATCFARNKTTYNKKYQYYSNKHCRGSTPRC

SEQ ID NO: 7644 - protein, 144 aa, Homo sapiens; identical to SEQ ID NO: 7643

SEQ ID NO: 7645 - protein, 145 aa, Homo sapiens
MELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSDKGSWCEQQLCACDKEVAFCLKRNLDTYQKRLRFYWRPHCRGQTPGC

SEQ ID NO: 7646 - protein, 142 aa, Homo sapiens
MKSPHVLVFLCLLVALVTGNLVQFGVMIEKMTGKSALQYNDYGCYCGIGGSHWPVDQTDWCCHAHDCCYGRLEKLGCEPKLEKYLFSVSERGIFCAGRTTCQRLTCECDKRAALCFRRNLGTYNRKYAHYPNKLCTGPTPPC

SEQ ID NO: 7647 - protein, 211 aa, Homo sapiens
MADGAKANPKGFKKKVLDRCFSGWRGPRFGASCPSRTSRSSLGMKKFFTVAILAGSVLSTAHGSLLNLKAMVEAVTGRSAILSFVGYGCYCGLGGRGQPKDEVDWCCHAHDCCYQELFDQGCHPYVDHYDHTIENNTEIVCSDLNKTECDKQTCMCDKNMVLCLMNQTYREEYRGFLNVYCQGPTPNCSIYEPPPEEVTCSHQSPAPPAPP

SEQ ID NO: 7648 - protein, 509 aa, Homo sapiens
MGVQAGLFGMLGFLGVALGGSPALRWYRTSCHLTKAVPGNPLGYLSFLAKDAQGLALIHARWDAHRRLQSCSWEDEPELTAAYGALCAHETAWGSFIHTPGPELQRALATLQSQWEACRALEESPAGARKKRAAGQSGVPGGGHQREKRGWTMPGTLWCGVGDSAGNSSELGVFQGPDLCCREHDRCPQNISPLQYNYGIRNYRFHTISHCDCDTRFQQCLQNQHDSISDIVGVAFFNVLEIPCFVLEEQEACVAWYWWGGCRMYGTVPLARLQPRTFYNASWSSRATSPTPSSRSPAPPKPRQKQHLRKGPPHQKGSKRPSKANTTALQDPMVSPRLDVAPTGLQGPQGGLKPQGARWVCRSFRRHLDQCEHQIGPREIEFQLLNSAQEPLFHCNCTRRLARFLRLHSPPEVTNMLWELLGTTCFKLAPPLDCVEGKNCSRDPRAIRVSARHLRRLQQRRHQLQDKGTDERQPWPSEPLRGPMSFYNQCLQLTQAARRPDRQQKSWSQ

SEQ ID NO: 7649 - protein, 749 aa, Homo sapiens
MSFIDPYQHIIVEHQYSHKFTVVVLRATKVTKGAFGDMLDTPDPYVELFISTTPDSRKRTRHFNNDINPVWNETFEFILDPNQENVLEITLMDANYVMDETLGTATFTVSSMKVGEKKEVPFIFNQVTEMVLEMSLEVCSCPDLRFSMALCDQEKTFRQQRKEHIRESMKKLLGPKNSEGLHSARDVPVVAILGSGGGFRAMVGFSGVMKALYESGILDCATYVAGLSGSTWYMSTLYSHPDFPEKGPEEINEELMKNVSHNPLLLLTPQKVKRYVESLWKKKSSGQPVTFTDIFGMLIGETLIHNRMNTTLSSLKEKVNTAQCPLPLFTCLHVKPDVSELMFADWVEFSPYEIGMAKYGTFMAPDLFGSKFFMGTVVKKYEENPLHFLMGVWGSAFSILFNRVLGVSGSQSRGSTMEEELENITTKHIVSNDSSDSDDESHEPKGTENEDAGSDYQSDNQASWIHRMIMALVSDSALFNTREGRAGKVHNFMLGLNLNTSYPLSPLSDFATQDSFDDDELDAAVADPDEFERIYEPLDVKSKKIHVVDSGLTFNLPYPLILRPQRGVDLIISFDFSARPSDSSPPFKELLLAEKWAKMNKLPFPKIDPYVFDREGLKECYVFKPKNPDMEKDCPTIIHFVLANINFRKYRAPGVPRETEEEKEIADFDIFDDPESPFSTFNFQYPNQAFKRLHDLMHFNTLNNIDVIKEAMVESIEYRRQNPSRCSVSLSNVEARRFFNKEFLSKPKA

SEQ ID NO: 7650 - protein, 49 aa, Homo sapiens [sequence omitted]

SEQ ID NO: 7651 - protein, 689 aa, Homo sapiens
MSFIDPYQHIIVEHQYSHKFTVVVLRATKVTKGAFGDMLDTPDPYVELFISTTPDSRKRTRHFNNDINPVWNETFEFILDPNQENVLEITLMDANYVMDETLGTATFTVSSMKVGEKKEVPFIFNQVPVVAILGSGGGFRAMVGFSGVMKALYESGILDCATYVAGLSGSTWYMSTLYSHPDFPEKGPEEINEELMKNVSHNPLLLLTPQKVKRYVESLWKKKSSGQPVTFTDIFGMLIGETLIHNRMNTTLSSLKEKVNTAQCPLPLFTCLHVKPDVSELMFADWVEFSPYEIGMAKYGTFMAPDLFGSKFFMGTVVKKYEENPLHFLMGVWGSAFSILFNRVLGVSGSQSRGSTMEEELENITTKHIVSNDSSDSDDESHEPKGTENEDAGSDYQSDNQASWIHRMIMALVSDSALFNTREGRAGKVHNFMLGLNLNTSYPLSPLSDFATQDSFDDDELDAAVADPDEFERIYEPLDVKSKKIHVVDSGLTFNLPYPLILRPQRGVDLIISFDFSARPSDSSPPFKELLLAEKWAKMNKLPFPKIDPYVFDREGLKECYVFKPKNPDMEKDCPTIIHFVLANINFRKYRAPGVPRETEEEKEIADFDIFDDPESPFSTFNFQYPNQAFKRLHDLMHFNTLNNIDVIKEAMVESIEYRRQNPSRCSVSLSNVEARRFFNKEFLSKPKA

SEQ ID NO: 7652 - protein, 781 aa, Homo sapiens
MAVAEVSRTCLLTVRVLQAHRLPSKDLVTPSDCYVTLWLPTACSHRLQTRTVKNSSSPVWNQSFHFRIHRQLKNVMELKVFDQDLVTGDDPVLSVLFDAGTLRAGEFRRESFSLSPQGEGRLEVEFRLQSLADRGEWLVSNGVLVARELSCLHVQLEETGDQKSSEHRVQLVVPGSCEGPQEASVGTGTFRFHCPACWEQELSIRLQDAPEEQLKAPLSALPSGQVVRLVFPTSQEPLMRVELKKEAGLRELAVRLGFGPCAEEQAFLSRRKQVVAAALRQALQLDGDLQEDEIPVVAIMATGGGIRAMTSLYGQLAGLKELGLLDCVSYITGASGSTWALANLYEDPEWSQKDLAGPTELLKTQVTKNKLGVLAPSQLQRYRQELAERARLGYPSCFTNLWALINEALLHDEPHDHKLSDQREALSHGQNPLPIYCALNTKGQSLTTFEFGEWCEFSPYEVGFPKYGAFIPSELFGSEFFMGQLMKRLPESRICFLEGIWSNLYAANLQDSLYWASEPSQFWDRWVRNQANLDKEQVPLLKIEEPPSTAGRIAEFFTDLLTWRPLAQATHNFLRGLHFHKDYFQHPHFSTWKATTLDGLPNQLTPSEPHLCLLDVGYLINTSCLPLLQPTRDVDLILSLDYNLHGAFQQLQLLGRFCQEQGIPFPPISPSPEEQLQPRECHTFSDPTCPGAPAVLHFPLVSDSFREYSAPGVRRTPEEAAAGEVNLSSSDSPYHYTKVTYSQEDVDKLLHLTHYNVCNNQEQLLEALRQAVQRRRQRRPH

SEQ ID NO: 7653 - protein, 138 aa, Homo sapiens
MKGLLPLAWFLACSVPAVQGGLLDLKSMIEKVTGKNALTNYGFYGCYCGWGGRGTPKDGTDWCCWAHDHCYGRLEEKGCNIRTQSYKYRFAWGVVTCEPGPFCHVNLCACDRKLVYCLKRNLRSYNPQYQYFPNILCS

SEQ ID NO: 7654 - protein, 806 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 7655 - protein, 427 aa, Homo sapiens
MQFFGRLVNTFSGVTNLFSNPFRVKEVAVADYTSSDRVREEGQLILFQNTPNRTWDCVLVNPRNSQSGFRCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLGSHPSQAGWWAWGAASDGTTGSHAHLTGPEASVHPGLHEGREADRQNMES

SEQ ID NO: 7656 - protein, 752 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRQLQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 7657 - protein, 479 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTDRT

SEQ ID NO: 7658 - protein, 752 aa, Homo sapiens; identical to SEQ ID NO: 7656

SEQ ID NO: 7659 - protein, 667 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 7660 - protein, 166 aa, Homo sapiens
MQFFGRLVNTFSGVTNLFSNPFRVKEVAVADYTSSDRVREEGQLILFQNTPNRTWDCVLVNPRNSQSGFRCANCAENEEGCTPLHLACRKGDGEILVELVQYCHTQMDVTDYKGETVFHYAVQGDNSQVLQLLGRNAVAGLNQVNNQGLTPLHLACQLGKQEMVRV

SEQ ID NO: 7661 - protein, 432 aa, Homo sapiens
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIIRVRSAHQVPGLWELISTHHEIEFSQPPQAVPIARRTRRAAHPCTWPAARVMGRSWWSWCSTATLRWMSPTTRERPSSIMLSRVTILRCCRCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLGSHPSQAGWWAWGAASDG

SEQ ID NO: 7662 - protein, 80 aa, Homo sapiens
MQFFGRLVNTFSGVTNLFSNPFRVKEVAVADYTSSDRVREEGQLILFQNTPNRTWDCVLVNPRNSQSGFRLFQLELEADA

SEQ ID NO: 7663 - protein, 165 aa, Homo sapiens
MGPLPVCLPIMLLLLLPSLLLLLLLPGPGSGEASRILRVHRRGILELAGTVGCVGPRTPIAYMKYGCFCGLGGHGQPRDAIDWCCHGHDCCYTRAEEAGCSPKTERYSWQCVNQSVLCGPAENKCQELLCKCDQEIANCLAQTEYNLKYLFYPQFLCEPDSPKCD

SEQ ID NO: 7664 - protein, 165 aa, Homo sapiens; identical to SEQ ID NO: 7663

SEQ ID NO: 7665 - protein, 189 aa, Homo sapiens
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 7666 - protein, 70 aa, Homo sapiens
MALLSRPALTLLLLLMAAVVRCQEQAQTTDWRATLKTIRNGVHKIDTYLNAALDLLGGEDGLCQYKCSDA

SEQ ID NO: 7667 - protein, 195 aa, Homo sapiens
MKLASGFLVLWLSLGGGLAQSDTSPDTEESYSDWGLRHLRGSFESVNSYFDSFLELLGGKNGVCQYRCRYGKAPMPRPGYKPQEPNGCGSYFLGLKVPESMDLGIPAMTKCCNQLDVCYDTCGANKYRCDAKFRWCLHSICSDLKRSLGFVSKVEAACDSLVDTVFNTVWTLGCRPFMNSQRAACICAEEEKEEL

SEQ ID NO: 7668 - protein, 1291 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKQENGDLSPFSGTSLRERGSDASGQLFHGRAREGSFESRYQQPFEDFRISQEHLADHFDSRERRAPRRTRVNGDNRL

SEQ ID NO: 7669 - protein, 1290 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKENGDLSPFSGTSLRERGSDASGQLFHGRAREGSFESRYQQPFEDFRISQEHLADHFDSRERRAPRRTRVNGDNRL

SEQ ID NO: 7670 - protein, 1291 aa, Homo sapiens; identical to SEQ ID NO: 7668

SEQ ID NO: 7671 - protein, 1265 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLHDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHFGEKWFHKKVEKRTSAEKLLQEYCMETGGKDGTFLVRESETFPNDYTLSFWRSGRVQHCRIRSTMEGGTLKYYLTDNLTFSSIYALIQHYRETHLRCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNMERDINSLYDVSRMYVDPSEINPSMPQRTVKALYDYKAKRSDELSFCRGALIHNVSKEPGGWWKGDYGTRIQQYFPSNYVEDISTADFEELEKQIIEDNPLGSLCRGILDLNTYNVVKAPQGKNQKSFVFILEPKQQGDPPVEFATDRVEELFEWFQSIREITWKIDTKENNMKYWEKNQSIAIELSDLVVYCKPTSKTKDNLENPDFREIRSFVETKADSIIRQKPVDLLKYNQKGLTRVYPKGQRVDSSNYDPFRLWLCGSQMVALNFQTADKYMQMNHALFSLNGRTGYVLQPESMRTEKYDPMPPESQRKILMTLTVKVLGARHLPKLGRSIACPFVEVEICGAEYDNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENQLQLYQEKCNKRLREKRVSNSKFYS

SEQ ID NO: 7672 - protein, 971 aa, Homo sapiens
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSSYFNHYRSHHNLIHGLKPHFKLFHPSSESEQGLTRPHADTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRSKMTPGVEDP

SEQ ID NO: 7673 - protein, 597 aa, Homo sapiens
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPIPGPSVVYRQVWESCMGKPDSGMERTTAISSSKTGFNLINLLLISLTGTPRPGCPGMTLPLQSTGRRLVMWHVTSSSAGTSQKL

SEQ ID NO: 7674 - protein, 1074 aa, Homo sapiens
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSSYFNHYRSHHNLIHGLKPHFKLFHPSSESEQGLTRPHADTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 7675 - protein, 1036 aa, Homo sapiens
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSNTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 7676 - protein, 142 aa, Homo sapiens
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIP

SEQ ID NO: 7677 - protein, 432 aa, Homo sapiens
MGPAGSLLGSGQMQITLWGSLAAVAIFFVITFLIFLCSSCDREKKPRQHSGDHENLMNVPSDKEMFSRSVTSLATDAPASSEQNGALTNGDILSEDSTLTCMQHYEEVQTSASDLLDSQDSTGKPKCHQSRELPRIPPESAVDTMLTARSVDGDQGLGMEGPYEVLKDSSSQENMVEDCLYETVKEIKEVAAAAHLEKGHSGKAKSTSASKELPGPQTEGKAEFAEYASVDRNKKCRQSVNVESILGNSCDPEEEAPPPVPVKLLDENENLQEKEGGEAEESATDTTSETNKRFSSLSYKSREEDPTLTEEEISAMYSSVNKPGQLVNKSGQSLTVPESTYTSIQGDPQRSPSSCNDLYATVKDFEKTPNSTLPPAGRPSEEPEPDYEAIQTLNREEEKATLGTNGHHGLVPKENDYESISDLQQGRDITRL

SEQ ID NO: 7678 - protein, 641 aa, Homo sapiens
MLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGTGKSYLLKRILGSLPPTGTVATASTGVAACHIGGTTLHAFAGIGSGQAPLAQCVALAQRPGVRQGWLNCQRLVIDEISMVEADLFDKLEAVARAVRQQNKPFGGIQLIICGDFLQLPPVTKGSQPPRFCFQSKSWKRCVPVTLELTKVWRQADQTFISLLQAVRLGRCSDEVTRQLQATASHKVGRDGIVATRLCTHQDDVALTNERRLQELPGKVHRFEAMDSNPELASTLDAQCPVSQLLQLKLGAQVMLVKNLSVSRGLVNGARGVVVGFEAEGRGLPQVRFLCGVTEVIHADRWTVQATGGQLLSRQQLPLQLAWAMSIHKSQGMTLDCVEISLGRVFASGQAYVALSRARSLQGLRVLDFDPMAVRCDPRVLHFYATLRRGRSLSLESPDDDEAASDQENMDPIL

SEQ ID NO: 7679 - protein, 707 aa, Homo sapiens
MLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGTGKSYLLKRILGSLPPTGTVATASTGVAACHIGGTTLHAFAGIGSGQAPLAQCVALAQRPGVRQGWLNCQRLVIDEISMVEADLFDKLEAVARAVRQQNKPFGGIQLIICGDFLQLPPVTKGSQPPRFCFQSKSWKRCVPVTLELTKVWRQADQTFISLLQAVRLGRCSDEVTRQLQATASHKVGRDGIVATRLCTHQDDVALTNERRLQELPGKVHRFEAMDSNPELASTLDAQCPVSQLLQLKLGAQVMLVKNLSVSRGLVNGARGVVVGFEAEGRGLPQVRFLCGVTEVIHADRWTVQATGGQLLSRQQLPLQLAWAMSIHKSQGMTLDCVEISLGRVFASGQAYVALSRARSLQGLRVLDFDPMAVRCDPRVLHFYATLRRGRSLSLAAEGRGNEDRCSGSSIRALGGDWWGLRLGAASKQRTELRCVSTARPSLAQPRTNTLQSLTKEHKLQNVHPYFKLLFQGINSVWGH

SEQ ID NO: 7680 - protein, 641 aa, Homo sapiens; identical to SEQ ID NO: 7678

SEQ ID NO: 7681 - protein, 266 aa, Homo sapiens
MLSGIEAAAGEYEDSELRCRVAVEELSPGGQPRRRQALRTAELSLGRNERRELMLRLQAPGPAGRPRCFPLRAARLFTRFAEAGRSTLRLPAHDTPGAGAVQLLLSDCPPDRLRRFLRTLRLKLAAAPGPGPASARAQLLGPRPRDFVTISPVQPEERRLRAATRVPDTTLVKRPVEPQAGAEPSTEAPRWPLPVKRLSLPSTKPQLSEEQAAVLRAVLKGQSIFFTGSAGSGGREEVGGQWWGGIEEQGDLSNFAPVQEQGSHIC

SEQ ID NO: 7682 - protein, 328 aa, Homo sapiens
MSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGKDLSSRSKTDLDCIFGKRQSKKTPEGDASPSTPEENETTTTSAFTIQEYFAKRMAALKNKPQVPVPGSDISETQVERKRGKKRNKEATGKDVESYLQPKAKRHTEGKPERAEAQERVAKKKSAPAEEQLRGPCWDQSSKASAQDAGDHVQPPEGRDFTLKPKKRRGKKKLQKPVEIAEDATLEETLVKKKKKKDSK

SEQ ID NO: 7683 - protein, 172 aa, Homo sapiens
MLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGRCQSLHSRGERNHDNQRLHHPGVLCQADGSTEEQAPGSSSRV

SEQ ID NO: 7684 - protein, 174 aa, Homo sapiens
MSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGRCQSLHSRGERNHDNQRLHHPGVLCQADGSTEEQAPGSSSRV

SEQ ID NO: 7685 - protein, 717 aa, Homo sapiens
MAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRRIFGLLMGTLQKFKQESTVATERQKRRQEIEQKLEVQAEEERKQVENERRELFEERRAKQTELRLLEQKVELAQLQEEWNEHNAKIIKYIRTKTKPHLFYIPGRMCPATQKLIEESQRKMNALFEGRRIEFAEQINKMEARPRRQSMKEKEHQVVRNEEQKAEQEEGKVAQREEELEETGNQHNDVEIEEAGEEEEKEIAIVHSDAEKEQEEEEQKQEMEVKMEEETEVRESEKQQDSQPEEVMDVLEMVENVKHVIADQEVMETNRVESVEPSENEASKELEPEMEFEIEPDKECKTLSPGKENVSALDMEKESEEKEEKESEPQPEPVAQPQPQSQPQLQLQSQSQPVLQSQPPSQPEDLSLAVLQPTPQVTQEQGHLLPERKDFPVESVKLTEVPVEPVLTVHPESKSKTKTRSRSRGRARNKTSKSRSRSSSSSSSSSSSTSSSSGSSSSSGSSSSRSSSSSSSSTSGSSSRDSSSSTSSSSESRSRSRGRGHNRDRKHRRSVDRKRRDTSGLERSHKSSKGGSSRDTKGSKDKNSRSDRKRSISESSRSGKRSSRSERDRKSDRKDKRR

SEQ ID NO: 7686 - protein, 221 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRHSPGRQSPDMPGDFRADAPSFLPPRRSLPMLFRMEWGCALTGSQSAVWPSSPVPEEIPRMHPGRNGKKQQRKPLREKMKPERCGDAVPRR

SEQ ID NO: 7687 - protein, 149 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERCGDAVPRR

SEQ ID NO: 7688 - protein, 170 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 7689 - protein, 158 aa, Homo sapiens
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 7690 - protein, 395 aa, Homo sapiens
MRALLARLLLCVLVVSDSKGSNELHQVPYKSKTCYEGNGHFYRGKASTDTMGRPCLPWNSATVLQQTYHAHRSDALQLGLGKHNYCRNPDNRRRPWCYVQVGLKLLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 7691 - protein, 395 aa, Homo sapiens; identical to SEQ ID NO: 7690

SEQ ID NO: 7692 - protein, 431 aa, Homo sapiens
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKLLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 7693 - protein, 414 aa, Homo sapiens
MVFHLRTRYEQANCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKLLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 7694 - protein, 290 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEVLELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 7695 - protein, 281 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHERSLWGSWLPCKSTTALRPPCCEEAQATHV

SEQ ID NO: 7696 - protein, 335 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 7697 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 7698 - protein, 182 aa, Homo sapiens
MPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 7699 - protein, 190 aa, Homo sapiens
MMQYTWLLTKQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 7700 - protein, 167 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPSNRGGKIIQLHTS

SEQ ID NO: 7701 - protein, 184 aa, Homo sapiens [sequence omitted]

SEQ ID NO: 7702 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 7703 - protein, 230 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVT

SEQ ID NO: 7704 - protein, 135 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRV

SEQ ID NO: 7705 - protein, 211 aa, Homo sapiens [sequence omitted]

SEQ ID NO: 7706 - protein, 196 aa, Homo sapiens
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 7707 - protein, 53 aa, Homo sapiens
MRTLACLLLLGCGYLAHVLAEEAEIPREVIERLARSQIHSIRDLQRLLEIDSV

SEQ ID NO: 7708 - protein, 1089 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 7709 - protein, 159 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPV

SEQ ID NO: 7710 - protein, 158 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETP

SEQ ID NO: 7711 - protein, 218 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKGTCIISFLL

SEQ ID NO: 7712 - protein, 154 aa, Homo sapiens
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTD

SEQ ID NO: 7713 - protein, 1106 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 7714 - protein, 174 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYD

SEQ ID NO: 7715 - protein, 776 aa, Homo sapiens
AASEPDTAGSVRGLPTAHCPVVDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 7716 - protein, 353 aa, Homo sapiens
MEDGVLKEGFLVKRGHIVHNWKARWFILRQNTLVYYKLEGGRRVTPPKGRILLDGCTITCPCLEYENRPLLIKLKTQTSTEYFLEACSREERDAWAFEITGAIHAGQPGKVQQLHSLRNSFKLPPHISLHRIVDKMHDSNTGIRSSPNMEQGSTYKKTFLGSSLVDWLISNSFTASRLEAVTLASMLMEENFLRPVGVRSMGAIRSGDLAEQFLDDSTALYTFAESYKKKISPKEEISLSTVELSGTVVKQGYLAKQGHKRKNWKVRRFVLRKDPAFLHYYDPSKEENRPVGGFSLRGSLVSALEDNGVPTGVKGNVQGNLFKVITKDDTHYYIQASSKAERAEWIEAIKKLT

SEQ ID NO: 7717 - protein, 577 aa, Homo sapiens
MPEGAQGLSLSKPSPSLGCGRRGEVCDCGTVCETRTAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGESMGLHRAQGAPDAPFHM

SEQ ID NO: 7718 - protein, 1386 aa, Homo sapiens
MPEGAQGLSLSKPSPSLGCGRRGEVCDCGTVCETRTAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARLESSDLTPPHSPPPSSRQLLGPNAAALSRYLAASYISQSLARRQGPGGGAPAASRGSWSSAPTSRASSPPPQPQPPPPPARRLSYATTVNIHVGGGGRLRPAKAQVRLNHPALLASTQESMGLHRAQGAPDAPFHM

SEQ ID NO: 7719 - protein, 577 aa, Homo sapiens; identical to SEQ ID NO: 7717

SEQ ID NO: 7720 - protein, 1357 aa, Homo sapiens
MPEGAQGLSLSKPSPSLGCGRRGEVCDCGTVCETRTAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARLESSDLTPPHSPPPSSRQLLGPNAAALSRYLAASYISQSLARRQGPGGGAPAASRGSWSSAPTSRASSPPPQPQPPPPPARRLSYATTVNIHVGGGGRLRPAKAQVRLNHPALLASTQESMGLHRAQGAPDAPFHM

SEQ ID NO: 7721 - protein, 198 aa, Homo sapiens
MPEGAQGLSLSKPSPSLGCGRRGEVCDCGTVCETRTAAPAAPTMASPRGSGSSTSLSTVGSEGDPAPGPTPACSASRPEPLPGPPIRLHLSPVGIPGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYP

SEQ ID NO: 7722 - protein, 1237 aa, Homo sapiens
MPEGAQGLSLSKPSPSLGCGRRGEVCDCGTVCETRTGSARPSRLERVAREIVETERAYVRDLRSIVEDYLGPLLDGGVLGLSVEQVGTLFANIEDIYEFSSELLEDLENSSSAGGIAECFVQRSEDFDIYTLYCMNYPSSLALLRELSLSPPAALWLQERQAQLRHSLPLQSFLLKPVQRILKYHLLLQELGKHWAEGPGTGGREMVEEAIVSMTAVAWYINDMKRKQEHAARLQEVQRRLGGWTGPELSAFGELVLEGAFRGGGGGGPRLRGGERLLFLFSRMLLVAKRRGLEYTYKGHIFCCNLSVSESPRDPLGFKVSDLTIPKHRHLLQAKNQEEKRLWIHCLQRLFFENHPASIPAKAKQVLLENSLHCAPKSKPVLEPLTPPLGSPRPRDARSFTPGRRNTAPSPGPSVIRRGRRQSEPVKDPYVMFPQNAKPGFKHAGSEGELYPPESQPPVSGSAPPEDLEDAGPPTLDPSGTSITEEILELLNQRGLRDPGPSTHDIPKFPGDSQVPGDSETLTFQALPSRDSSEEEEEEEEGLEMDERGPSPLHVLEGLESSIAAEMPSIPCLTKIPDVPNLPEIPSRCEIPEGSRLPSLSDISDVFEMPCLPAIPSVPNTPSLSSTPTLSCDSWLQGPLQEPAEAPATRRELFSGSNPGKLGEPPSGGKAGPEEDEEGVSFTDFQPQDVTQHQGFPDELAFRSCSEIRSAWQALEQGQLARPGFPEPLLILEDSDLGGDSGSGKAGAPSSERTASRVRELARLYSERIQQMQRAETRASANAPRRRPRVLAQPQPSPCLPQEQAEPGLLPAFGHVLVCELAFPLTCAQESVPLGPAVWVQAAIPLSKQGGSPDGQGLHVSNLPKQDLPGIHVSAATLLPEQGGSRHVQAPAATPLPKQEGPLHLQVPALTTFSDQGHPEIQVPATTPLPEHRSHMVIPAPSTAFCPEQGHCADIHVPTTPALPKEICSDFTVSVTTPVPKQEGHLDSESPTNIPLTKQGGSRDVQGPDPVCSQPIQPLSWHGSSLDPQGPGDTLPPLPCHLPDLQIPGTSPLPAHGSHLDHRIPANAPLSLSQELPDTQVPATTPLPLPQVLTDIWVQALPTSPKQGSLPDIQGPAAAPPLPEPSLTDTQVQKLTPSLEQKSLIDAHVPAATPLPERGGSLDIQGLSPTPVQTTMVLSKPGGSLASHVARNLWAFTGPRGLLMPPSTCEPGHEASLKQGFQPDAIDPQNLTWKSRH

SEQ ID NO: 7723 - protein, 375 aa, Homo sapiens
MMKKNNSAKRGPQDGNQQPAPPEKVGWVRKFCGKGIFREIWKNRYVVLKGDQLYISEKEVKDEKNIQEVFDLSDYEKCEELRKSKSRSKKNHSKFTLAHSKQPGNTAPNLIFLAVSPEEKESWINALNSAITRAKNRILDEASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 7724 - protein, 409 aa, Homo sapiens
MMKKNNSAKRGPQDGNQQPAPPEKVGWVRKFCGKGIFREIWKNRYVVLKGDQLYISEKEVKDEKNIQEVFDLSDYEKCEELRKSKSRSKKNHSKFTLAHSKQPGNTAPNLIFLAVSPEEKESWINALNSAITRAKNRILDEVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 7725 - protein, 226 aa, Homo sapiens
MLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPPDSESEQLLLETERLLGEASSNWSQAKRVLQEVRELRDLYRQMDLQTPDSHLRQTTPHSQYRKSLM

SEQ ID NO: 7726 - protein, 224 aa, Homo sapiens
MPSTLPSPEPRTVSWMSTSLQVTVEEDSYLAHPTRDRAKIQHSRRPPTRGHLMAVASTSTSDGMLTLDLIQEEDPSPEEPTSCAESFRVDLDKSVAQLAGSRRRADSDRIQPSADRASSLSRPWEKTDKGATYTPQAPKKLTPTEKGRCASLEEILSQRDAASARTLQLRAEEPPTPALPNPGQLSRIQDLVARKLEETQELLAEVQGLGDGKRKAKDPPRSPP

SEQ ID NO: 7727 - protein, 127 aa, Homo sapiens
MTAAATATVLKEGVLEKRSGGLLQLWKRKRCVLTERGLQLFEAKGTGGRPKELSFARIKAVECVESTGRHIYFTLVTEGGGEIDFRCPLEDPGWNAQITLGLVKFKNQQAIQTVRARQSLGTGTLVS

SEQ ID NO: 7728 - protein, 127 aa, Homo sapiens; identical to SEQ ID NO: 7727

SEQ ID NO: 7729 - protein, 569 aa, Homo sapiens
MSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTESF

SEQ ID NO: 7730 - protein, 756 aa, Homo sapiens
MSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 7731 - protein, 73 aa, Homo sapiens
MKQLPAATVRLLSSSQIITSVVSVVKELIENSLDAGATSVDVKLENYGFDKIEVRDNGEGIKAVDAPVMAMKY

SEQ ID NO: 7732 - protein, 194 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNK

SEQ ID NO: 7733 - protein, 756 aa, Homo sapiens; identical to SEQ ID NO: 7730

SEQ ID NO: 7734 - protein, 932 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 7735 - protein, 44 aa, Homo sapiens
MKQLPAATVRLLSSSQIITSVVSVVKELIENSLDAGATSVDVKL

SEQ ID NO: 7736 - protein, 770 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLNLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 7737 - protein, 893 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 7738 - protein, 862 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 7739 - protein, 461 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 7740 - protein, 815 aa, Homo sapiens
MERAESSRSKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 7741 - protein, 572 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGLKTGPSDPRTSMN

SEQ ID NO: 7742 - protein, 756 aa, Homo sapiens
MWGRRRKLRRLNDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 7743 - protein, 603 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 7744 - protein, 247 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPAVPCLQCAPQPRWLGRAASSLQVGVAV

SEQ ID NO: 7745 - protein, 506 aa, Homo sapiens
MSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 7746 - protein, 646 aa, Homo sapiens
MEPAAGFLSPRPFQRAAAAPAPPAGPGPPPSALRGPELEMLAGLPTSDPGRLITDPRSGRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKTVHYNPTSTKHFSFSVGAVPRALQPQLGILRYFASYMEQHLMKGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 7747 - protein, 621 aa, Homo sapiens
SRQRHARPGPGGTEKPGPRCDAPAAWSLPPVSCLRTYLKGRLLGKGGFARCYEATDTETGSAYAVKVIPQSRVAKPHQREKILNEIELHRDLQHRHIVRFSHHFEDADNIYIFLELCSRKSLAHIWKARHTLLEPEVRYYLRQILSGLKYLHQRGILHRDLKLGNFFITENMELKVGDFGLAARLEPPEQRKKTICGTPNYVAPEVLLRQGHGPEADVWSLGCVMYTLLCGSPPFETADLKETYRCIKQVHYTLPASLSLPARQLLAAILRASPRDRPSIDQILRHDFFTKGYTPDRLPISSCVTVPDLTPPNPARSLFAKVTKSLFGRKKKSKNHAQERDEVSGLVSGLMRTSVGHQDARPEAPAASGPAPVSLVETAPEDSSPRGTLASSGDGFEEGLTVATVVESALCALRNCIAFMPPAEQNPAPLAQPEPLVWVSKWVDYSNKFGFGYQLSSRRVAVLFNDGTHMALSANRKTVHYNPTSTKHFSFSVGAVPRALQPQLGILRYFASYMEQHLMKGGDLPSVEEVEVPAPPLLLQWVKTDQALLMLFSDGTVQVNFYGDHTKLILSGWEPLLVTFVARNRSACTYLASHLRQLGCSPDLRQRLRYALRLLRDRSPA

SEQ ID NO: 7748 - protein, 970 aa, Homo sapiens
MATCIGEKIEDFKVGNLLGKGSFAGVYRAESIHTGLEVAIKMIDKKAMYKAGMVQRVQNEVKIHCQLKHPSILELYNYFEDSNYVYLVLEMCHNGEMNRYLKNRVKPFSENEARHFMHQIITGMLYLHSHGILHRDLTLSNLLLTRNMNIKIADFGLATQLKMPHEKHYTLCGTPNYISPEIATRSAHGLESDVWSLGCMFYTLLIGRPPFDTDTVKNTLNKVVLADYEMPSFLSIEAKDLIHQLLRRNPADRLSLSSVLDHPFMSRNSSTKSKDLGTVEDSIDSGHATISTAITASSSTSISGSLFDKRRLLIGQPLPNKMTVFPKNKSSTDFSSSGDGNSFYTQWGNQETSNSGRGRVIQDAEERPHSRYLRRAYSSDRSGTSNSQSQAKTYTMERCHSAEMLSVSKRSGGGENEERYSPTDNNANIFNFFKEKTSSSSGSFERPDNNQALSNHLCPGKTPFPFADPTPQTETVQQWFGNLQINAHLRKTTEYDSISPNRDFQGHPDLQKDTSKNAWTDTKVKKNSDASDNAHSVKQQNTMKYMTALHSKPEIIQQECVFGSDPLSEQSKTRGMEPPWGYQNRTLRSITSPLVAHRLKPIRQKTKKAVVSILDSEEVCVELVKEYASQEYVKEVLQISSDGNTITIYYPNGGRGFPLADRPPSPTDNISRYSFDNLPEKYWRKYQYASRFVQLVRSKSPKITYFTRYAKCILMENSPGADFEVWFYDGVKIHKTEDFIQVIEKTGKSYTLKSESEVNSLKEEIKMYMDHANEGHRICLALESIISEEERKTRSAPFFPIIIGRKPGSTSSPKALSPPPSVDSNYPTRERASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKLQCLSSILLMFSNPTPNFH

SEQ ID NO: 7749 - protein, 938 aa, Homo sapiens
MATCIGEKIEDFKVGNLLGKGSFAGVYRAESIHTGLEVAIKMLYNYFEDSNYVYLVLEMCHNGEMNRYLKNRVKPFSENEARHFMHQIITGMLYLHSHGILHRDLTLSNLLLTRNMNIKIADFGLATQLKMPHEKHYTLCGTPNYISPEIATRSAHGLESDVWSLGCMFYTLLIGRPPFDTDTVKNTLNKVVLADYEMPSFLSIEAKDLIHQLLRRNPADRLSLSSVLDHPFMSRNSSTKSKDLGTVEDSIDSGHATISTAITASSSTSISGSLFDKRRLLIGQPLPNKMTVFPKNKSSTDFSSSGDGNSFYTQWGNQETSNSGRGRVIQDAEERPHSRYLRRAYSSDRSGTSNSQSQAKTYTMERCHSAEMLSVSKRSGGGENEERYSPTDNNANIFNFFKEKTSSSSGSFERPDNNQALSNHLCPGKTPFPFADPTPQTETVQQWFGNLQINAHLRKTTEYDSISPNRDFQGHPDLQKDTSKNAWTDTKVKKNSDASDNAHSVKQQNTMKYMTALHSKPEIIQQECVFGSDPLSEQSKTRGMEPPWGYQNRTLRSITSPLVAHRLKPIRQKTKKAVVSILDSEEVCVELVKEYASQEYVKEVLQISSDGNTITIYYPNGGRGFPLADRPPSPTDNISRYSFDNLPEKYWRKYQYASRFVQLVRSKSPKITYFTRYAKCILMENSPGADFEVWFYDGVKIHKTEDFIQVIEKTGKSYTLKSESEVNSLKEEIKMYMDHANEGHRICLALESIISEEERKTRSAPFFPIIIGRKPGSTSSPKALSPPPSVDSNYPTRERASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKLQCLSSILLMFSNPTPNFH

SEQ ID NO: 7750 - protein, 929 aa, Homo sapiens
MIDKKAMYKAGMVQRVQNEVKIHCQLKHPSILELYNYFEDSNYVYLVLEMCHNGEMNRYLKNRVKPFSENEARHFMHQIITGMLYLHSHGILHRDLTLSNLLLTRNMNIKIADFGLATQLKMPHEKHYTLCGTPNYISPEIATRSAHGLESDVWSLGCMFYTLLIGRPPFDTDTVKNTLNKVVLADYEMPSFLSIEAKDLIHQLLRRNPADRLSLSSVLDHPFMSRNSSTKSKDLGTVEDSIDSGHATISTAITASSSTSISGSLFDKRRLLIGQPLPNKMTVFPKNKSSTDFSSSGDGNSFYTQWGNQETSNSGRGRVIQDAEERPHSRYLRRAYSSDRSGTSNSQSQAKTYTMERCHSAEMLSVSKRSGGGENEERYSPTDNNANIFNFFKEKTSSSSGSFERPDNNQALSNHLCPGKTPFPFADPTPQTETVQQWFGNLQINAHLRKTTEYDSISPNRDFQGHPDLQKDTSKNAWTDTKVKKNSDASDNAHSVKQQNTMKYMTALHSKPEIIQQECVFGSDPLSEQSKTRGMEPPWGYQNRTLRSITSPLVAHRLKPIRQKTKKAVVSILDSEEVCVELVKEYASQEYVKEVLQISSDGNTITIYYPNGGRGFPLADRPPSPTDNISRYSFDNLPEKYWRKYQYASRFVQLVRSKSPKITYFTRYAKCILMENSPGADFEVWFYDGVKIHKTEDFIQVIEKTGKSYTLKSESEVNSLKEEIKMYMDHANEGHRICLALESIISEEERKTRSAPFFPIIIGRKPGSTSSPKALSPPPSVDSNYPTRERASFNRMVMHSAASPTQAPILNPSMVTNEGLGLTTTASGTDISSNSLKDCLPKSAQLLKSVFVKNVGWATQLTSGAVWVQFNDGSQLVVQAGVSSISYTSPNGQTTRYGENEKLPDYIKQKLQCLSSILLMFSNPTPNFH

SEQ ID NO: 7751 - protein, 583 aa, Homo sapiens
MAARRRRSTGGGRARALNESKRVNNGNTAPEDSSPAKKTRRCQRQESKKMPVAGGKANKDRTEDKQDGMPGRSWASKRVSESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 7752 - protein, 570 aa, Homo sapiens
MAARRRRSTGGGRARALNESKRVNNGNTAPEDSSPAKKTRRCQRQESKKMPVAGGKANKDRTEDKQDESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 7753 - protein, 540 aa, Homo sapiens
MSLLFLAMAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNHWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 7754 - protein, 533 aa, Homo sapiens
MAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNHWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSGAPEYKVIQTYLEQTGSNHRCPTLQHIWKVNQEGEEDRFQAHSKLGNRKLLWHGTNMAVVAAILTSGLRIMPHSGGRVGKGIYFASENSKSAGYVIGMKCGAHHVGYMFLGEVALGREHHINTDNPSLKSPPPGFDSVIARGHTEPDPTQDTELELDGQQVVVPQGQPVPCPEFSSSTFSQSEYLIYQESQCRLRYLLEVHL

SEQ ID NO: 7755 - protein, 533 aa, Homo sapiens; identical to SEQ ID NO: 7754

SEQ ID NO: 7756 - protein, 332 aa, Homo sapiens
MAPKPKPWVQTEGPEKKKGRQAGREEDPFRSTAEALKAIPAEKRIIRVDPTCPLSSNPGTQVYEDYNCTLNQTNIENNNNKFYIIQLLQDSNRFFTCWNHWGRVGEVGQSKINHFTRLEDAKKDFEKKFREKTKNNWAERDHFVSHPGKYTLIEVQAEDEAQEAVVKVDRGPVRTVTKRVQPCSLDPATQKLITNIFSKEMFKNTMALMDLDVKKMPLGKLSKQQIARGFEALEALEEALKGPTDGGQSLEELSSHFYTVIPHNFGHSQPPPINSPELLQAKKDMLLVLADIELAQALQAVSEQEKTVEEVPHPLDRDYQLLKCQLQLLDSG

SEQ ID NO: 7757 - protein, 1724 aa, Homo sapiens
MVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMNSSTLSQEVSDLVEMIWAEALGHLEHMLLKPVNRISLNDVSKAEGILLLVKAALKNGETAEQLQKMMTEFYRLIPHKGTMPKEVNLGLLAKKADLCQLIRDMVNVCETNLSKPNPPSLAKYRALRCKIEHVEQNTEEFLRVRKEVLQNHHSKSPVDVLQIFRVGRVNETTEFLSKLGNVRPLLHGSPVQNIVGILCRGLLLPKVVEDRGVQRTDVGNLGSGIYFSDSLSTSIKYSHPGETDGTRLLLICDVALGKCMDLHEKDFSLTEAPPGYDSVHGVSQTASVTTDFEDDEFVVYKTNQVKMKYIIKFSMPGDQIKDFHPSDHTELEEYRPEFSNFSKVEDYQLPDAKTSSSTKAGLQDASGNLVPLEDVHIKGRIIDTVAQVIVFQTYTNKSHVPIEAKYIFPLDDKAAVCGFEAFINGKHIVGEIKEKEEAQQEYLEAVTQGHGAYLMSQDAPDVFTVSVGNLPPKAKVLIKITYITELSILGTVGVFFMPATVAPWQQDKALNENLQDTVEKICIKEIGTKQSFSLTMSIEMPYVIEFIFSDTHELKQKRTDCKAVISTMEGSSLDSSGFSLHIGLSAAYLPRMWVEKHPEKESEACMLVFQPDLDVDLPDLASESEVIICLDCSSSMEGVTFLQAKQIALHALSLVGEKQKVNIIQFGTGYKELFSYPKHITSNTMAAEFIMSATPTMGNTDFWKTLRYLSLLYPARGSRNILLVSDGHLQDESLTLQLVKRSRPHTRLFACGIGSTANRHVLRILSQCGAGVFEYFNAKSKHSWRKQIEDQMTRLCSPSCHSVSVKWQQLNPDVPEALQAPAQVPSLFLNDRLLVYGFIPHCTQATLCALIQEKEFRTMVSTTELQKTTGTMIHKLAARALIRDYEDGILHENETSHEMKKQTLKSLIIKLSKENSLITQFTSFVAVEKRDENESPFPDIPKVSELIAKEDVDFLPYMSWQGEPQEAVRNQSLLASSEWPELRLSKRKHRKIPFSKRKMELSQPEVSEDFEEDGLGVLPAFTSNLERGGVEKLLDLSWTESCKPTATEPLFKKVSPWETSTSSFFPILAPAVGSYLPPTARAHSPASLSFASYRQVASFGSAAPPRQFDASQFSQGPVPGTCADWIPQSASCPTGPPQNPPSSPYCGIVFSGSSLSSAQSAPLQHPGGFTTRPSAGTFPELDSPQLHFSLPTDPDPIRGFGSYHPSASSPFHFQPSAASLTANLRLPMASALPEALCSQSRTTPVDLCLLEESVGSLEGSRCPVFAFQSSDTESDELSEVLQDSCFLQIKCDTKDDSILCFLEVKEEDEIVCIQHWQDAVPWTELLSLQTEDGFWKLTPELGLILNLNTNGLHSFLKQKGIQSLGVKGRECLLDLIATMLVLQFIRTRLEKEGIVFKSLMKMDDASISRNIPWAFEAIKQASEWVRRTEGQYPSICPRLELGNDWDSATKQLLGLQPISTVSPLHRVLHYSQG

SEQ ID NO: 7758 - protein, 636 aa, Homo sapiens
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 7759 - protein, 547 aa, Homo sapiens
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 7760 - protein, 42 aa, Homo sapiens
  MOD_RES (1)..(1): Any amino acid
XMLESPESLRSKVDEAVAVLQAHQAKEAAQKAVNSATGVPTV

SEQ ID NO: 7761 - protein, 38 aa, Homo sapiens
MNPSAPSYPMASLYVGDLHPDVTEAMLYEKFSPAGPIL

SEQ ID NO: 7762 - protein, 118 aa, Homo sapiens
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDT

SEQ ID NO: 7763 - protein, 43 aa, Homo sapiens
MNPSAPSYPMASLYVGDLHPDVTEAMLYEKFSPAGPILSIRVC

SEQ ID NO: 7764 - protein, 169 aa, Homo sapiens
  MOD_RES (1)..(1): Any amino acid
XASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 7765 - protein, 61 aa, Homo sapiens
MNPSAPSYPMASLYVGDLHPDVTEAMLYEKFSPAGPILSIRVCRDMITRRSLGYAYVNFQQ

SEQ ID NO: 7766 - protein, 129 aa, Homo sapiens
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCK

SEQ ID NO: 7767 - protein, 183 aa, Homo sapiens
IRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 7768 - protein, 75 aa, Homo sapiens
MNPSAPSYPMASLYVGDLHPDVTEAMLYEKFSPAGPILSIRVCRDMITRRSLGYAYVNFQQPADAERALDTMNFD

SEQ ID NO: 7769 - protein, 335 aa, Homo sapiens
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 7770 - protein, 239 aa, Homo sapiens
  MOD_RES (1)..(1): Any amino acid
XGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTVLQATREDLMHNMLLGPQLKAIKELQENPCQWIVKKTSLITSSGNTGNPRTGANEACILPGRHNPIGVLIYFLTFAM

SEQ ID NO: 7771 - protein, 280 aa, Homo sapiens
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEGSQLDSCPVKGHLNGTESLLDLIWDVMTILKLKNADLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKN

SEQ ID NO: 7772 - protein, 237 aa, Homo sapiens
  MOD_RES (1)..(1): Any amino acid
XEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 7773 - protein, 181 aa, Homo sapiens
MLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 7774 - protein, 575 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 7775 - protein, 298 aa, Homo sapiens
MHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 7776 - protein, 515 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALQGGAWPSAAHSH

SEQ ID NO: 7777 - protein, 300 aa, Homo sapiens
MLMHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 7778 - protein, 575 aa, Homo sapiens; identical to SEQ ID NO: 7774

SEQ ID NO: 7779 - protein, 171 aa, Homo sapiens
MDYERALRLLRLPQLPPGAQLVKSAWLSLCLQERRLVDVAGFSIFIPSSPSLMMKPVMGKKPRLVQLIWKPSSVATTPPPLREIVSLAQPLLSWISGSVHSPQARRRPITTSISQRSWKFWPKPTVFRETSGGPWAMPRPSMPSRASISLSPRTRRPAVSLGLGSGWLRKS

SEQ ID NO: 7780 - protein, 248 aa, Homo sapiens
MEALCVCSLMPLHWSWILTASHLAAFFQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 7781 - protein, 575 aa, Homo sapiens; identical to SEQ ID NO: 7774

SEQ ID NO: 7782 - protein, 487 aa, Homo sapiens
MDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 7783 - protein, 515 aa, Homo sapiens; identical to SEQ ID NO: 7776

SEQ ID NO: 7784 - protein, 269 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSV

SEQ ID NO: 7785 - protein, 470 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEAVPSVGPGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPT

SEQ ID NO: 7786 - protein, 334 aa, Homo sapiens
MDPRGILKAFPKRQKIHADASSKPSCASALRCLCPESDIGADSACPGPAEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLR

SEQ ID NO: 7787 - protein, 218 aa, Homo sapiens
MHHQKYLQRFLGGKREKKQKEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVP

SEQ ID NO: 7788 - protein, 188 aa, Homo sapiens
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNT

SEQ ID NO: 7789 - protein, 171 aa, Homo sapiens; identical to SEQ ID NO: 7779

SEQ ID NO: 7790 - protein, 152 aa, Homo sapiens
MDYERALRLLRLPQLPPGAQLVKSAWLSLCLQERRLVDVAGFSIFIPSSPSLMMKPVMGKKPRLVQLIWKPSSVATTPPPLREIVSLAQPLLSWISGSVHSPQARRRPITTSISQRSWKFWPKPTVFRETSGGPWAMPRPSMPSRASISLSP

SEQ ID NO: 7791 - protein, 312 aa, Homo sapiens
MHHQKYLQRFLGGKREKKQKPISDDEASDGEETQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 7792 - protein, 466 aa, Homo sapiens
MADQLYLENIDEFVTDQNKIVTYKWLSYTLGVHVNQAKQMLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIVEQPTVSVTEPKLATPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 7793 - protein, 427 aa, Homo sapiens
MLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIVEQPTVSVTEPKLATPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 7794 - protein, 360 aa, Homo sapiens
MLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIVEQPTVSVTEPKLATPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 7795 - protein, 267 aa, Homo sapiens
MADQLYLENIDEFVTDQNKIVTYKWLSYTLGVHVNQAKQMLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIKEKKR

SEQ ID NO: 7796 - protein, 521 aa, Homo sapiens
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 7797 - protein, 232 aa, Homo sapiens
MLGAMFRAGTPMPPNLNSQGGGHYFIDRDGKAFRHILNFLRLGRLDLPRGYGETALLRAEADFYQIRPLLDALRELEASQGTPAPTAALLHADVDVSPRLVHFSARRGPHHYELSSVQVDTFRANLFCTDSECLGALRARFGVASGDRAEGSPHFHLEWAPRPVELPEVEYGRLGLQPLWTGGPGERREVVGTPSFLEEVLRVALEHGFRLDSVFPDPEDLLNSRSLRFVRH

SEQ ID NO: 7798 - protein, 1718 aa, Homo sapiens
MNQNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKGKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFSYSLRLASRCSPPAAPYITRQYRKVKAPAAAQFQGPFFKE

SEQ ID NO: 7799 - protein, 1682 aa, Homo sapiens
MNQNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKGKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRNFL

SEQ ID NO: 7800 - protein, 1481 aa, Homo sapiens
MRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRNFL

SEQ ID NO: 7801 - protein, 226 aa, Homo sapiens
MNQNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKATASAWRPDALHQRPRTSPGSIGRSKLQLQPSSRDHSSKSRHSGCSLTAPEVTWNQ

SEQ ID NO: 7802 - protein, 1682 aa, Homo sapiens
MNQNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKGKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFRCFL

SEQ ID NO: 7803 - protein, 78 aa, Homo sapiens
MRDSAEGPKEDEEKPSASALEQPATLQEVASQEVPPELATPAPAWEPQPEPDERLEAAACEVNDLGEEEEEEEEEDEE

SEQ ID NO: 7804 - protein, 1481 aa, Homo sapiens; identical to SEQ ID NO: 7800

SEQ ID NO: 7805 - protein, 140 aa, Homo sapiens
MAGWNAYIDNLMADGTCQDAAIVGYKDSPSVWAAVPGKTFVNITPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 7806 - protein, 831 aa, Homo sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 7807 - protein, 933 aa, Homo sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 7808 - protein, 695 aa, Homo sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGFRNLHIDDQITLIQYSWMSLMVFGLGWRSYKHVSGQMLYFAPDLILNDSFGRATKSNPV

SEQ ID NO: 7809 - protein, 764 aa, Homo sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNESHRSLSSFKLAKKSSSV

SEQ ID NO: 7810 - protein, 339 aa, Homo sapiens
MEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNEQRMKESSFYSLCLTMWQIPQEFVKLQVSQEEFLCMKVLLLLNTIPLEGLRSQTQFEEMRSSYIRELIKAIGLRQKGVVSSSQRFYQLTKLLDNLHDLVKQLHLYCLNTFIQSRALSVEFPEMMSEVIAAQLPKILAGMVKPLLFHKK

SEQ ID NO: 7811 - protein, 803 aa, Homo sapiens
MTELKAKGPRAPHVAGGPPSPEVGSPLLCRPAAGPFPGSQTSDTLPEVSAIPISLDGLLFPRPCQGQDPSDEKTQDQQSLSDVEGAYSRAEATRGAGGSSSSPPEKDSGLLDSVLDTLLAPSGPGQSQPSPPACEVTSSWCLFGPELPEDPPAAPATQRVLSPLMSRSGCKVGDSSGTAAAHKVLPRGLSPARQLLLPASESPHWSGAPVKPSPQAAAVEVEEEDGSESEESAGPLLKGKPRALGGAAAGGGAAAVPPGAAAGGVALVPKEDSRFSAPRVALVEQDAPMAPGRSPLATTVMDFIHVPILPLNHALLAARTRQLLEDESYDGGAGAASAFAPPRSSPCASSTPVAVGDFPDCAYPPDAEPKDDAYPLYSDFQPPALKIKEEEEGAEASARSPRSYLVAGANPAAFPDFPLGPPPPLPPRATPSRPGEAAVTAAPASASVSSASSSGSTLECILYKAEGAPPQQGPFAPPPCKAPGASGCLLPRDGLPSTSASAAAAGAAPALYPALGLNGLPQLGYQAAVLKEGLPQVYPPYLNYLRPDSEASQSPQYSFESLPQKICLICGDEASGCHYGVLTCGSCKVFFKRAMEGQHNYLCAGRNDCIVDKIRRKNCPACRLRKCCQAGMVLGGRKFKKFNKVRVVRALDAVALPQPVGVPNESQALSQRFTFSPGQDIQLIPPLINLLMSIEPDVIYAGHDNTKPDTSSSLLTSLNQLGERQLLSVVKWSKSLPGFRNLHIDDQITLIQYSWMSLMVFGLGWRSYKHVSGQMLYFAPDLILNESHRSLSSFKLAKKSSSV

SEQ ID NO: 7812 - protein, 690 aa, Homo sapiens [sequence omitted]

SEQ ID NO: 7813 - protein, 469 aa, Homo sapiens
MDVENEQILNVNPADPDNLSDSLFSGDEENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 7814 - protein, 458 aa, Homo sapiens
MTKYPDNLSDSLFSGDEENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 7815 - protein, 231 aa, Homo sapiens
MDVENEQILNVNPAENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLK

SEQ ID NO: 7816 - protein, 261 aa, Homo sapiens
MFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLGIPEQEYSCVVKMPSGEFARICRDLSHIGDAVVISCAKDGVKFSASGELGNGNIKLSQTSNVDKEEEAVTIEMNEPVQLTFALRYLNFFTKATPLSSTVTLSMSADVPLVVEYKIADMGHLKYYLAPKIEDEEGS

SEQ ID NO: 7817 - protein, 261 aa, Homo sapiens; identical to SEQ ID NO: 7816

SEQ ID NO: 7818 - protein, 379 aa, Homo sapiens
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 7819 - protein, 388 aa, Homo sapiens
MRTLRRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 7820 - protein, 267 aa, Homo sapiens
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGT

SEQ ID NO: 7821 - protein, 226 aa, Homo sapiens
MSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLL

SEQ ID NO: 7822 - protein, 411 aa, Homo sapiens
MVCLELSQREAWGSGSPEKMPAQPEGLYRLKFMSSPSLSDLGKREPAAAADERGTQQRRACANATWNSIHNGVIAVFQRKGLPDQELFSLNEGVRQLLKTELGSFFTEYLQNQLLTKGMVILRDKIRFYEGQKLLDSLAETWDFFFSDVLPMLQAIFYPVQGKEPSVRQLALLHFRNAITLSVKLEDALARAHARVPPAIVQMLLVLQGVHESRGVTEDYLRLETLVQKVVSPYLGTYGLHSSEGPFTHSCILEKRLLRRSRSGDVLAKNPVVRSKSYNTPLLNPVQEHEAEGAAAGGTSIRRHSVSEMTSCPEPQGFSDPPGQGPTGTFRSSPAPHSGPCPSRLYPTTQPPEQGLDPTRSSLPRSSPENLVDQILESVDSDSEGIFIDFGRGRGSGMSDLEGSGGRQSVV

SEQ ID NO: 7823 - protein, 882 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEAFFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 7824 - protein, 829 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGESRAQTLGAGVPPGDSVRGSMEASQVQVPLEASPITFPPPCAPERPPISPVPGARQAGL

SEQ ID NO: 7825 - protein, 781 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSCMEPMETAEPQSSPAHSSPAHSSPAHSSPVQSLLRAQGASSLPCGTYHPPAWPPHQPAEQAATPDAEPHSEPPDHQERPAVHRGIRYLLYRAQRAIRLRHALRLHPQLHRAPIRTWSPHVVQASTPAITGPLNHPANAQEHPAQLQRGISPPHRIRGAVRSRSRSLRGSSHLSQWLNNFFALPFSSMASQLDMSSVVGAGESRAQTLGAGVPPGDSVRGSMEASQVQVPLEASPITFPPPCAPERPPISPVPGARQAGL

SEQ ID NO: 7826 - protein, 423 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLRNALW

SEQ ID NO: 7827 - protein, 435 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLLPPPAHALTGPAQSSTH

SEQ ID NO: 7828 - protein, 633 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 7829 - protein, 443 aa, Homo sapiens
MAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEAFFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 7830 - protein, 865 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEAFFSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 7831 - protein, 611 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSVSGPEVQPRTPASPHFRSQGAQPQQVTLRLALRLGNFPVRH

SEQ ID NO: 7832 - protein, 560 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAGRERNALW

SEQ ID NO: 7833 - protein, 585 aa, Homo sapiens
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNESGFSWGYPHPFLI

SEQ ID NO: 7834 - protein, 160 aa, Homo sapiens
MQPASAKWYDRRDYVFIEFCVEDSKDVNVNFEKSKLTFSCLGGSDNFKHLNEIDLFHCIDPNDSKHKRTDRSILCCLRKGESGQSWPRLTKERAKLNWLSVDFNNWKDWEDDSDEDMSNFDRFSEMMNNMGGDEDVDLPEVDGADDDSQDSDDEKMPDLE

SEQ ID NO: 7835 - protein, 562 aa, Homo sapiens
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 7836 - protein, 599 aa, Homo sapiens
MSRSLLLWFLLFLLLLPPLPVLLADPGAPTPVNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 7837 - protein, 490 aa, Homo sapiens
MLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKVGSQEYSYEQFLFNTSMLVDYGVEALVDAFSRQIAGRIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 7838 - protein, 156 aa, Homo sapiens
SLLLWFLLFLLLLPPLPVLLADPGAPTPAGLWTWLRNSLRPSPSFTHFLLTHGRWFWEFVNATFIREMLMRLVLTVRSNLIPSPPTYNSAHDYISWESFSNFFKTSGKMGPGFTKALGHGVDLGHIYGDNLERQYQLRLFKDGKLKYQVLDGEMYP

SEQ ID NO: 7839 - protein, 537 aa, Homo sapiens
MRKPRLMNPCCYYPCQHQGICVRFGLDRYQCDCTRTGYSGPNCTIPGLWTWLRNSLRPSPSFTHFLLTHGRWFWEFVNATFIREMLMRLVLTVRSNLIPSPPTYNSAHDYISWESFSNVSYYTRILPSVPKDCPTPMGTKGKKQLPDAQLLARRFLLRRKFIPDPQGTNLMFAFFAQHFTHQFFKTSGKMGPGFTKALGHGVDLGHIYGDNLERQYQLRLFKDGKLKYQVLDGEMYPPSVEEAPVLMHYPRGIPPQSQMAVGQEVFGLLPGLMLYATLWLREHNRVCDLLKAEHPTWGDEQLFQTTRLILIGETIKIVIEEYVQQLSGYFLQLKFDPELLFGVQFQYRNRIAMEFNHLYHWHPLMPDSFKIGGGRNMDHHILHVAVDVIRESREMRLQPFNEYRKRFGMKPYTSFQELVGEKEMAAELEELYGDIDALEFYPGLLLEKCHPNSIFGESMIEIGAPFSLKGLLGNPICSPEYWKPSTFGGEVGFNIVKTATLKKLVCLNTKTCPYVSFRVPDASQDDGPAVERPSTEL

SEQ ID NO: 7840 - protein, 604 aa, Homo sapiens
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 7841 - protein, 537 aa, Homo sapiens
SLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEELDIVLQ

SEQ ID NO: 7842 - protein, 634 aa, Homo sapiens
MSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 7843 - protein, 340 aa, Homo sapiens
LSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPNGVSLRPPGWSSVARSRLIAASTS

SEQ ID NO: 7844 - protein, 503 aa, Homo sapiens
MVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGCKQCSSLRSIQNLNSLVDKTSWIPSSVAEALGIVPLQYVFVMTFTLDDGTGVLEAYLMDSDKFFQIPASEVLMDDDLQKSVDMIMDMFCPPGIKIDAYPWLECFIKSYNVTNGTDNQICYQIFDTTVAEDVI

SEQ ID NO: 7845 - protein, 459 aa, Homo sapiens
LSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEVLL

SEQ ID NO: 7846 - protein, 82 aa, Homo sapiens
MSLVPATNYIYTPLNQLKGGTIVNVYGVVKFFKPPYLSKGTDYCSVVTIVDQTNVKLTCLLFSGNYEALPIIYKNGDIVRFH

SEQ ID NO: 7847 - protein, 518 aa, Homo sapiens
LSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFPSSGSVSLYEVERCQQLSATILTDHQYLERTPLCAILKQKAPQQYRIRAKLRSYKPRRLFQSVKLHCPKCHLLQEVPHEGDLDIIFQDGATKTPDVKLQNTSLYDSKIWTTKNQKGRKVAVHFVKNNGILPLSNECLLLIEGGTLSEICKLSNKFNSVIPVRSGHEDLELLDLSAPFLIQGTIHHYGTGYCTPPICVCYDLYT

SEQ ID NO: 7848 - protein, 457 aa, Homo sapiens
SPEDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQVMFCYIFMFVYCCVM

SEQ ID NO: 7849 - protein, 672 aa, Homo sapiens
MADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSVCKGLMTKHPAKRLGCGPEGERDVREHAFFRRIDWEKLENREIQPPFKPKVCGKGAENFDKFFTRGQPVLTPPDQLVIANIDQSDFEGFSYVNPQFVHPILQSAV

SEQ ID NO: 7850 - protein, 673 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKACGRNAENFDRFFTRHPPVLTPPDQEVIRNIDQSEFEGFSFVNSEFLKPEVKS

SEQ ID NO: 7851 - protein, 671 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKARDKRDTSNFDKEFTRQPVELTPTDKLFIMNLDQNEFAGFSYTNPEFVINV

SEQ ID NO: 7852 - protein, 261 aa, Homo sapiens
MRESALERGPVPEAPAGGPVHAVTVVTLLEKLASMLETLRERQGGLARRQGGLAGSVRRIQSGLGALSRSHDTTSNTLAQLLAKAERVSSHANAAQERAVRRAAQVQRLEANHGLLVARGKLHVLLFKEEGEVPASAFQKAPEPLGPADQSELGPEQLEAEVGESSDEEPVESRAQRLRRTGLQKVQSLRRALSGRKGPAAPPPTPVKPPRLGPGRSAEAQPEAQPALEPTLEPEPPQDTEEDPGRPGAAEEALLQMESVA

SEQ ID NO: 7853 - protein, 737 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 7854 - protein, 127 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYV

SEQ ID NO: 7855 - protein, 697 aa, Homo sapiens
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 7856 - protein, 327 aa, Homo sapiens
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWLVTTPWNCMSGCGWAPLPLPSPPLPLVPPTPSAASSGRVQDACTSPTSASSWF

SEQ ID NO: 7857 - protein, 710 aa, Homo sapiens
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVISCTPAFQLCPRGF

SEQ ID NO: 7858 - protein, 548 aa, Homo sapiens
MPRICDLRVSRRWEGPPDGRCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 7859 - protein, 592 aa, Homo sapiens
MPSRTGPKMEGSGGRVRLKAHYGGDIFITSVDAATTFEELCEEVRDMCRLHQQHPLTLKWVDSEGDPCTVSSQMELEEAFRLARQCRDEGLIIHVFPSTPEQPGLPCPGEDKSIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 7860 - protein, 409 aa, Homo sapiens
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 7861 - protein, 409 aa, Homo sapiens; identical to SEQ ID NO: 7860

SEQ ID NO: 7862 - protein, 488 aa, Homo sapiens
MLTPRTDESIYRRGARRWRKLYRANGHLFQAKRFNRRAYCGQCSERIWGLARQGYRCINCKLLVHKRCHGLVPLTCRKHMDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALGVLMFEMMAGRSPFDIITDNPDMNTEDYLFQVILEKPIRIPRFLSVKASHVLKGFLNKDPKERLGCRPQTGFSDIKSHAFFRSIDWDLLEKKQALPPFQPQITDDYGLDNFDTQFTSEPVQLTPDDEDAIKRIDQSEFEGFEYINPLLLSTEESV

SEQ ID NO: 7863 - protein, 25 aa, Homo sapiens
MDSVMPSQEPPVDDKNEDADLPSEE

SEQ ID NO: 7864 - protein, 82 aa, Homo sapiens
MDSVMPSQEPPVDDKNEDADLPSEETDGIAYISSSRKHDSIKDDSEDLKPVIDGMDGIKISQGLGLQDFDLIRVIGRGSYAK

SEQ ID NO: 7865 - protein, 98 aa, Homo sapiens
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMK

SEQ ID NO: 7866 - protein, 109 aa, Homo sapiens
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDE

SEQ ID NO: 7867 - protein, 46 aa, Homo sapiens
MDSVMPSQEPPVDDKNEDADLPSEETDGIAYISSSRKHDSIKDDSE

SEQ ID NO: 7868 - protein, 73 aa, Homo sapiens
MDSVMPSQEPPVDDKNEDADLPSEETDGIAYISSSRKHDSIKDDSEDLKPVIDGMDGIKISQGLGLQDFDLIR

SEQ ID NO: 7869 - protein, 21 aa, Homo sapiens
MDSVMPSQEPPVDDKNEDADL

SEQ ID NO: 7870 - protein, 71 aa, Homo sapiens
MDSVMPSQEPPVDDKNEDADLPSEETDGIAYISSSRKHDSIKDDSEDLKPVIDGMDGIKISQGLGLQDFDL

SEQ ID NO: 7871 - protein, 270 aa, Homo sapiens
MGNTSSERAALERHGGHKTPRRDSSGGTKDGDRPKILMDSPEDADLFHSEEIKAPEKEEFLAWQHDLEVNDKAPAQARPTVFRWTGGGKEVYLSGSFNNWSKLPLTRSHNNFVAILDLPEGEHQYKFFVDGQWTHDPSEPIVTSQLGTVNNIIQVKKTDFEVFDALMVDSQKCSDVSELSSSPPGPYHQEPYVCKPEERFRAPPILPPHLLQVILNKDTGISCDPALLPEPNHVMLNHLYALSIKDGVMVLSATHRYKKKYVTTLLYKPI

SEQ ID NO: 7872 - protein, 233 aa, Homo sapiens
MDSPEDADLFHSEEIKAPEKEEFLAWQHDLEVNDKAPAQARPTVFRWTGGGKEVYLSGSFNNWSKLPLTRSHNNFVAILDLPEGEHQYKFFVDGQWTHDPSEPIVTSQLGTVNNIIQVKKTDFEVFDALMVDSQKCSDVSELSSSPPGPYHQEPYVCKPEERFRAPPILPPHLLQVILNKDTGISCDPALLPEPNHVMLNHLYALSIKDGVMVLSATHRYKKKYVTTLLYKPI

SEQ ID NO: 7873 - protein, 270 aa, Homo sapiens; identical to SEQ ID NO: 7871

SEQ ID NO: 7874 - protein, 4127 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSRLGLIEWLENTVTLKDLLLNTMSQEEKAAYLSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 7875 - protein, 4096 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 7876 - protein, 147 aa, Homo sapiens
MAAQRLGKRVLSKLQSPSRARGPGGSPGGLQKRHARVTVKYDRRELQRRLDVEKWIDGRLEELYRGMEADMPDEINIDELLELESEEERSRKIQGLLKSCGKPVEDFIQELLAKLQGLHRQPGLRQPSPSHDGSLSPLQDRARTAHP

SEQ ID NO: 7877 - protein, 120 aa, Homo sapiens
MAAQRLGKRVLSKLQSPSRARGPGGSPGGLQKRHARVTVKYDRRELQRRLDVEKWIDGRLEELYRGMGLLKSCGKPVEDFIQELLAKLQGLHRQPGLRQPSPSHDGSLSPLQDRARTAHP

SEQ ID NO: 7878 - protein, 674 aa, Homo sapiens
MAPGQAPHQATPWRDAHPFFLLSPVMGLLSRAWSRLRGLGPLEPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 7879 - protein, 514 aa, Homo sapiens
MKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 7880 - protein, 632 aa, Homo sapiens
MPWLVEAVKGAALVEAGLEGEARTPLAIPHTPWGRRPEEEAEDSGGPGEDRETLGLKTSSSLPEAWGLLDDDDGMYGEREATSVPRGQGSQFADGQRAPLSPSLLIRTLQGSDKNPGEEKAEEEGVAEEEGVNKFSYPPSHRECCPAVEEEDDEEAVKKEAHRTSTSALSPGSKPSTWVSCPGEEENQATEDKRTERSKGARKTSVSPRSSGSDPRSWEYRSGEASEEKEEKAHKETGKGEAAPGPQSSAPAQRPQLKSWWCQPSDEEEGEVKALGAAEKDGEAECPPCIPPPSAFLKAWVYWPGEDTEEEEDEEEDEDSDSGSDEEEGEAEASSSTPATGVFLKSWVYQPGEDTEEEEDEDSDTGSAEDEREAETSASTPPASAFLKAWVYRPGEDTEEEEDEDVDSEDKEDDSEAALGEAESDPHPSHPDQRAHFRGWGYRPGKETEEEEAAEDWGEAEPCPFRVAIYVPGEKPPPPWAPPRLPLRLQRRLKRPETPTHDPDPETPLKARKVRFSEKVTVHFLAVWAGPAQAARQGPWEQLARDRSRFARRITQAQEELSPCLTPAARARAWARLRNPPLAPIPALTQTLPSSSVPSSPVQTTPLSQAVATPSRSSAAAAAALDLSGRRG

SEQ ID NO: 7881 - protein, 556 aa, Homo sapiens
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKCPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 7882 - protein, 589 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 7883 - protein, 579 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 7884 - protein, 156 aa, Homo sapiens
MAAADGDDSLYPIAVLIDELRNEDVQLRLNSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 7885 - protein, 534 aa, Homo sapiens
MRTFSFASTASRSCPPSPWPLGLKGPEVSFCLSLQPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWRVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 7886 - protein, 667 aa, Homo sapiens
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVVAQRLRKLEFPVKDSGEPSVPRADKNHFPRPTVPGEDMGKGPVYQLRGDTRDTLAQLGIAELVHFSQSTD

SEQ ID NO: 7887 - protein, 474 aa, Homo sapiens
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 7888 - protein, 454 aa, Homo sapiens
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVKNGRRPSSKCSLQCGQISTKDWTNSRYQCFTGRSEASTTEVRSR

SEQ ID NO: 7889 - protein, 603 aa, Homo sapiens
MAGASELGTGPGAAGGDGDDSLYPIAVLIDELRNEDVQPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVVAQRLRKLEFPVKDSGEPSVPRADKNHFPRPTVPGEDMGKGPVYQLRGDTRDTLAQLGIAELVHFSQSTD

SEQ ID NO: 7890 - protein, 440 aa, Homo sapiens
MMQLTFWLRVPPPFSHFKRQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 7891 - protein, 601 aa, Homo sapiens
MAGASELGTGPGAAGGDGDDSLYPIAVLIDELRNEDVQLRLNSIKKLSTIALALGVERTRSELLPFLTDTIYDEDEVLLALAEQLGNFTGLVGGPDFAHCLLPPLENLATVEETVVRDKAVESLRQISQEHTPVALEAYFVPLVKRLASGDWFTSRTSACGLFSVCYPRASNAVKAEIRQQFRSLCSDDTPMVRRAAASKLGEFAKVLELDSVKSEIVPLFTSLASDEQDSVRLLAVEACVSIAQLLSQDDLETLVMPTLRQAAEDKSWRVRYMVADRFSELQKAMGPKITLNDLIPAFQNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLGVEFFDEKLNSLCMAWLVDHVYAIREAATNNLMKLVQKFGTEWAQNTIVPKVLVMANDPNYLHRMTTLFCINALSEACGQEITTKQMLPIVLKMAGDQVANVRFNVAKSLQKIGPILDTNALQGEVKPVLQKLGQDEDMDVKYFAQEAISVLALA

SEQ ID NO: 7892 - protein, 119 aa, Homo sapiens
MPRSPLKCPWIPSSRLGTGSACWLRLNSIKKLSTIALALGVERTRSELLPFLTDTIYDEDEVLLALAEQLGNFTGLVGGPDFAHCLLPPLENLATVEETVVRDKAVESLRQISQEHTPV

SEQ ID NO: 7893 - protein, 224 aa, Homo sapiens
  MOD_RES (1)..(1): Any amino acid
XNLLKDCEAEVRAAAAHKVKELGENLPIEDRETIIMNQILPYIKELVSDTNQHVKSALASVIMGLSTILGKENTIEHLLPLFLAQLKDECPDVRLNIISNLDCVNEVIGIRQLSQSLLPAIVELAEDAKWRVRLAIIEYMPLLAGQLALSEACGQEITTKQMLPIVLKMAGDQVANVRFNVAKSLQKIGPILDTNALQGEVKPVLQKLGQDEDMDVKYFAQEAI

SEQ ID NO: 7894 - protein, 521 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEDHYIPSYQKGSTTVRKEIIRNKIRAIGKMARVFSILRQESESVLTLKGLTPTGTLPLGVLSGGKQTIETATVEAVEAREAIRGFSLQHKIRSFEEARGLDRINERMPPRKDSIHAGGPMKSVTSAHSHAAHRSDQGKKAHS

SEQ ID NO: 7895 - protein, 469 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKVTEMLVNVLNICSDDELGSEEDGFDGATAAARKEVIRNKIRAIGKMARVFSVLREESESVLTLKGLTPTGMLPSGVLSGGKQTLQSAIKGFSPQHKITSFEEAKGLDRINERMPPRRDAMPSDANLNSINKALTSETNGTDSNGSNSSNIQ

SEQ ID NO: 7896 - protein, 511 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSAIKGFSPQHKITSFEEAKGLDRINERMPPRRDAMPSDANLNSINKALTSETNGTDSNGSNSSNIQ

SEQ ID NO: 7897 - protein, 521 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 7898 - protein, 423 aa, Homo sapiens
MKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 7899 - protein, 289 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 7900 - protein, 454 aa, Homo sapiens
MSEPKAIDPKLSTTDRVVKVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 7901 - protein, 132 aa, Homo sapiens
MKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAF

SEQ ID NO: 7902 - protein, 147 aa, Homo sapiens
MKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLC

SEQ ID NO: 7903 - protein, 496 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDGSAAARKEIIRNKIRAIGKMARVFSVLREESESVLTLKGLTPTGMLPSGVLAGGRQTLQSGNDVMQLAVPQMDWGTPHSFANNSHNACREFLLFFSSCLSS

SEQ ID NO: 7904 - protein, 524 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 7905 - protein, 514 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIEHVLGTEDISINPHNNINECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDGSAAARKEIIRNKIRAIGKMARVFSVLREESESVLTLKGLTPTGMLPSGVLAGGRQTLQSGNDVMQLAVPQMDWGTPHSFANNSHNACREFLLFFSSCLSS

SEQ ID NO: 7906 - protein, 196 aa, Homo sapiens
MNIRQFNCSPHPYWLPNFMDVFTWSLPFVGEKVTEMLVNVLSICSDDELMTEGEDQFDERLIYGNKKGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 7907 - protein, 515 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDVGSAAARKEIIRNKIRAIGKMARVFSVLREESESVLTLKGLTPTGMLPSGVLAGGRQTLQSAIRGFSPPHRICSFEEAKGLDRINERMPPRKDAVQQDGFNSLNTAHATENHGTGNHTAQ

SEQ ID NO: 7908 - protein, 525 aa, Homo sapiens
MAAPEPARAAPPPPPPPPPPPGADRVVKAVPFPPTHRLTSEEVFDLDGIPRVDVLKNHLVKEGRVDEEIALRIINEGAAILRREKTMIEVEAPITVCGDIHGQFFDLMKLFEVGGSPANTRYLFLGDYVDRGYFSIECVLYLWVLKILYPSTLFLLRGNHECRHLTEYFTFKQECKIKYSERVYEACMEAFDSLPLAALLNQQFLCVHGGLSPEIHTLDDIRRLDRFKEPPAFGPMCDLLWSDPSEDFGNEKSQEHFSHNTVRGCSYFYNYPAVCEFLQNNNLLSIIRAHEAQDAGYRMYRKSQTTGFPSLITIFSAPNYLDVYNNKAAVLKYENNVMNIRQFNCSPHPYWLPNFMDVFTWSLPFVGEKVTEMLVNVLSICSDDELMTEGEDQFDVGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 7909 - protein, 186 aa, Homo sapiens
HPYWLPNFMDVFTWSLPFVGEKVTEMLVNVLSICSDDELMTEGEDQFDERLIYGNKKGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 7910 - protein, 152 aa, Homo sapiens
MLVNVLSICSDDELMTEGEDQFDGSAAARKEIIRNKIRAIGKMARVFSVLREESESVLTLKGLTPTGMLPSGVLAGGRQTLQSATVEAIEAEKAIRGFSPPHRICSFEEAKGLDRINERMPPRKDAVQQDGFNSLNTAHATENHGTGNHTAQ

SEQ ID NO: 7911 - protein, 411 aa, Homo sapiens [sequence omitted]

SEQ ID NO: 7912 - protein, 512 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEGSTTVRKEIIRNKIRAIGKMARVFSILRQESESVLTLKGLTPTGTLPLGVLSGGKQTIETATVEAVEAREAIRGFSLQHKIRSFEEARGLDRINERMPPRKDSIHAGGPMKSVTSAHSHAAHRSDQGKKAHS

SEQ ID NO: 7913 - protein, 502 aa, Homo sapiens
MSGRRFHLSTTDRVIKAVPFPPTQRLTFKEVFENGKPKVDVLKNHLVKEGRLEEEVALKIINDGAAILRQEKTMIEVDAPITVCGDIHGQFFDLMKLFEVGGSPSNTRYLFLGDYVDRGYFSIECVLYLWSLKINHPKTLFLLRGNHECRHLTDYFTFKQECRIKYSEQVYDACMETFDCLPLAALLNQQFLCVHGGMSPEITSLDDIRKLDRFTEPPAFGPVCDLLWSDPSEDYGNEKTLEHYTHNTVRGCSYFYSYPAVCEFLQNNNLLSIIRAHEAQDAGYRMYRKSQATGFPSLITIFSAPNYLDVYNNKAAVLKYENNVMNIRQFNCSPHPYWLPNFMDVFTWSLPFVGEKVTEMLVNVLNICSDDELISDDEAEGSTTVRKEIIRNKIRAIGKMARVFSILRQESESVLTLKGLTPTGTLPLGVLSGGKQTIETAIRGFSLQHKIRSFEEARGLDRINERMPPRKDSIHAGGPMKSVTSAHSHAAHRSDQGKKAHS

SEQ ID NO: 7914 - protein, 170 aa, Homo sapiens
MGNEASYPLEMCSHFDADEIKRLGKRFKKLDLDNSGSLSVEEFMSLPELQQNPLVQRVIDIFDTDGNGEVDFKEFIEGVSQFSVKGDKEQKLRFAFRIYDMDKDGYISNGELFQVLKMMVGNNLKDTQLQQIVDKTIINADKDGDGRISFEEFCAVVGGLDIHKKMVVDV

SEQ ID NO: 7915 - protein, 173 aa, Homo sapiens
MSTMGNEASYPAEMCSHFDNDEIKRLGRRFKKLDLDKSGSLSVEEFMSLPELRHNPLVRRVIDVFDTDGDGEVDFKEFILGTSQFSVKGDEEQKLRFAFSIYDMDKDGYISNGELFQVLKMMVGNNLTDWQLQQLVDKTIIILDKDGDGKISFEEFSAVVRDLEIHKKLVLIV

SEQ ID NO: 7916 - protein, 139 aa, Homo sapiens [sequence omitted]

SEQ ID NO: 7917 - protein, 605 aa, Homo sapiens
MAGLYSLGVSVFSDQGGRKYMEDVTQIVVEPEPTAEEKPSPRRSLSQPLPPRPSPAALPGGEVSGKGPAVAAREARDPLPDAGASPAPSRCCRRRSSVAFFAVCDGHGGREAAQFAREHLWGFIKKQKGFTSSEPAKVCAAIRKGFLACHLAMWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKSLEEDPWPRVNSKDHIPALVRSNAFSENFLEVSAEIARENVQGVVIPSKDPEPLEENCAKALTLRIHDSLNNSLPIGLVPTNSTNTVMDQKNLKMSTPGQMKAQEIERTPPTNFKRTLEESNSGPLMKKHRRNGLSRSSGAQPASLPTTSQRKNSVKLTMRRRLRGQKKIGNPLLHQHRKTVCVC

SEQ ID NO: 7918 - protein, 430 aa, Homo sapiens
MAGLYSLGVSVFSDQGGRKYMEDVTQIVVEPEPTAEEKPSPRRSLSQPLPPRPSPAALPGGEVSGKGPAVAAREARDPLPDAGASPAPSRCCRRRSSVAFFAVCDGHGGREAAQFAREHLWGFIKKQKGFTSSEPAKVCAAIRKGFLACHLAMWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKDFGFELDSRK

SEQ ID NO: 7919 - protein, 278 aa, Homo sapiens
MWKKLAEWPKTMTGLPSTSGTTASVVIIRGMKMYVAHVGDSGVVLGIQDDPKDDFVRAVEVTQDHKPELPKERERIEGLGGSVMNKSGVNRVVWKRPRLTHNGPVRRSTVIDQIPFLAVARALGDLWSYDFFSGEFVVSPEPDTSVHTLDPQKHKYIILGSDGLWNMIPPQDAISMCQDQEEKKYLMGEHGQSCAKMLVNRALGRWRQRMLRADNTSAIVICISPEVDNQGNFTNEDELYLNLTDSPSYNSQETCVMTPSPCSTPPVKDFGFELDSRK

SEQ ID NO: 7920 - protein, 1143 aa, Homo sapiens
MYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 7921 - protein, 34 aa, Homo sapiens
MYLWLKLLAFGFAFLDTEVFVTGQSPTPSPTGKN

SEQ ID NO: 7922 - protein, 148 aa, Homo sapiens
MARMNRPAPVEVTYKNMRFLITHNPTNATLNKFIEELKKYGVTTIVRVCEATYDTTLVEKEGIHVLDWPFDDGAPPSNQIVDDWLSLVKIKFREEPGCCIAVHCVAGLGRKRRGAFNSKQLLYLEKYRPKMRLRFKDSNGHRNNCCIQ

SEQ ID NO: 7923 - protein, 148 aa, Homo sapiens; identical to SEQ ID NO: 7922

SEQ ID NO: 7924 - protein, 173 aa, Homo sapiens
MARMNRPAPVEVTYKNMRFLITHNPTNATLNKFIEELKKYGVTTIVRVCEATYDTTLVEKEGIHVLDWPFDDGAPPSNQIVDDWLSLVKIKFREEPGCCIAVHCVAGLGRAPVLVALALIEGGMKYEDAVQFIRQKRRGAFNSKQLLYLEKYRPKMRLRFKDSNGHRNNCCIQ

SEQ ID NO: 7925 - protein, 435 aa, Homo sapiens
MEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 7926 - protein, 362 aa, Homo sapiens
MEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 7927 - protein, 593 aa, Homo sapiens [sequence omitted]

SEQ ID NO: 7928 - protein, 216 aa, Homo sapiens
MTSRRWFHPNITGVEAENLLLTRGVDGSFLARPSKSNPGDFTLSVRRNGAVTHIKIQNTGDYYDLYGGEKFATLAELVQYYMEHHGQLKEKNGDVIELKYPLNCADPTSERWFHGHLSGKEAEKLLTEKGKHGSFLVRESQSHPGDFVLSVRTGDDKGESNDGKSKVTHVMIRCQELKYDVGGGERFDSLTDLVEHYKKNPMVETLGTVLQLKQPL

SEQ ID NO: 7929 - protein, 460 aa, Homo sapiens
MTSRRWFHPNITGVEAENLLLTRGVDGSFLARPSKSNPGDFTLSVRRNGAVTHIKIQNTGDYYDLYGGEKFATLAELVQYYMEHHGQLKEKNGDVIELKYPLNCADPTSERWFHGHLSGKEAEKLLTEKGKHGSFLVRESQSHPGDFVLSVRTGDDKGESNDGKSKVTHVMIRCQELKYDVGGGERFDSLTDLVEHYKKNPMVETLGTVLQLKQPLNTTRINAAEIESRVRELSKLAETTDKVKQGFWEEFETLQQQECKLLYSRKEGQRQENKNKNRYKNILPFDHTRVVLHDGDPNEPVSDYINANIIMPEFETKCNNSKPKKSYIATQGCLQNTVNDFWRMVFQENSRVIVMTTKEVERGKSKCVKYWPDEYALKEYGVMRVRNVKESAAHDYTLRELKLSKVGQGNTERTVWQYHFRTWPDHGVPSDPGGVLDFLEEVHHKQESIMDAGPVVVHCR

SEQ ID NO: 7930 - protein, 240 aa, Homo sapiens
MYLWLKLLAFGFAFLDTEVFVTGQSPTPSPTGHLQAEEQGSQSKSPNLKSREADSSAFSWWPKAREPLTNHWRLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNAS

SEQ ID NO: 7931 - protein, 1143 aa, Homo sapiens; identical to SEQ ID NO: 7920

SEQ ID NO: 7932 - protein, 1256 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 7933 - protein, 735 aa, Homo sapiens
MTMYLWLKLLAFGFAFLDTEVFVTGQSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVN

SEQ ID NO: 7934 - protein, 733 aa, Homo sapiens
MYLWLKLLAFGFAFLDTEVFVTGQSPTPSPTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVN

SEQ ID NO: 7935 - protein, 1306 aa, Homo sapiens
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 7936 - protein, 146 aa, Homo sapiens
MYLWLKLLAFGFAFLDTEVFVTGQSPTPSPTDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLH

SEQ ID NO: 7937 - protein, 116 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTP

SEQ ID NO: 7938 - protein, 1304 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 7939 - protein, 598 aa, Homo sapiens
MYLWLKLLAFGFAFLDTEVFVTGQSPTPSPTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYID

SEQ ID NO: 7940 - protein, 756 aa, Homo sapiens
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKQKSK

SEQ ID NO: 7941 - protein, 553 aa, Homo sapiens
SDYMIIKKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEACHYTSLHWNWCRYISDPNVDCPDPRNAEVTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSFQNPAQMLPASGRLPNQPCPERENYSFATF

SEQ ID NO: 7942 - protein, 976 aa, Homo sapiens
RSFIILKAIVSQPPGPVLSGMEMLLMSGYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSDEIPGAETDDYAEIIDEEDTYTMPSIKSYCIDVARDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKPLRLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7943 - protein, 1007 aa, Homo sapiens
KAEYDRYLASSKIMAAAYLDPNLNHTPKEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSGVSHCQHKVKKARRFLPLVFCSHDPPSTDEISGDETDDYAEIIDEEDTYTMPSIKSYCIDVARDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKPLRLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7944 - protein, 1065 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPGKEEKNWAERNPAAPPKKPPRPGAPGHLGSLASLSSPADSYNEGVKPNQLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7945 - protein, 750 aa, Homo sapiens
MADLIDGYCRLVNGTSQSFIIRPQKEGERALPSIPKLANSEKQGMRTHAVSVSGVSHCQHKVKKARRFLPLVFCSHDPPSTDEISGDETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKPCRLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7946 - protein, 362 aa, Homo sapiens
MRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7947 - protein, 117 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPP

SEQ ID NO: 7948 - protein, 1096 aa, Homo sapiens
MLLELAGQEALKPAGAIYMEKSGCSPFPVCWAKEYDRYLASSKIMAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7949 - protein, 1096 aa, Homo sapiens; identical to SEQ ID NO: 7948

SEQ ID NO: 7950 - protein, 680 aa, Homo sapiens
MKYQEVRCLTSFNISVSFPAETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7951 - protein, 1017 aa, Homo sapiens
  MOD_RES (1)..(1): Any amino acid
XYDRYLASSKIMAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7952 - protein, 117 aa, Homo sapiens; identical to SEQ ID NO: 7947

SEQ ID NO: 7953 - protein, 156 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYM

SEQ ID NO: 7954 - protein, 1052 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7955 - protein, 65 aa, Homo sapiens
MAAAYLDPNLNHTPNSSTKTHLGTGMERSPGAMERVLKVFHYFESNSEPTTWASIIRHGDATDVR

SEQ ID NO: 7956 - protein, 107 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSV

SEQ ID NO: 7957 - protein, 119 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEE

SEQ ID NO: 7958 - protein, 753 aa, Homo sapiens
AENMADLIDGYCRLVNGTSQSFIIRPQKEGERALPSIPKLANSEKQGMRTHAVSVSGVSHCQHKVKKARRFLPLVFCSHDPPSTDEISGDETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKPWRLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7959 - protein, 1052 aa, Homo sapiens; identical to SEQ ID NO: 7954

SEQ ID NO: 7960 - protein, 724 aa, Homo sapiens
IAENMADLIDGYCRLVNGTSQSFIIRPQKEGERALPSIPKLANSEKQGMRTHAVSVSETDDYAEIIDEEDTYTMPSKSYGIDEARDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7961 - protein, 120 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEW

SEQ ID NO: 7962 - protein, 51 aa, Homo sapiens
MAAAYLDPNLNHTPNSSTKTHLGTGMERSPGAMERVLKVFHYFESNSEPTT

SEQ ID NO: 7963 - protein, 1006 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7964 - protein, 720 aa, Homo sapiens
MADLIDGYCRLVNGTSQSFIIRPQKEGERALPSIPKLANSEKQGMRTHAVSVSETDDYAEIIDEEDTYTMPSKSYGIDEARDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7965 - protein, 1065 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPGKEEKNWAERNPAAPPKKPPRPGAPGHLGSLASLSSPADSYNEGVKPWRLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 7966 - protein, 967 aa, Homo sapiens
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQEEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 7967 - protein, 1009 aa, Homo sapiens
MSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQVPEGLCASSPTLTSPMEYPSPVNSLHTPPLHRHNVFKRHSMREEDFIQPSSREEAQQLWEAEKVKMRQILDKQQKQMVEDYQWLRQEEKSLDPMVYMNDKSPLTPEKEVGYLEFTGPPQKPPRLGAQSIQPTANLDRTDDLVYLNVMELVRAVLELKNELCQLPPEGYVVVVKNVGLTLRKLIGSVDDLLPSLPSSSRTEIEGTQKLLNKDLAELINKMRLAQQNAVTSLSEECKRQMLTASHTLAVDAKNLLDAVDQAKVLANLAHPPAE

SEQ ID NO: 7968 - protein, 1009 aa, Homo sapiens; identical to SEQ ID NO: 7967

SEQ ID NO: 7969 - protein, 967 aa, Homo sapiens; identical to SEQ ID NO: 7966

SEQ ID NO: 7970 - protein, 967 aa, Homo sapiens; identical to SEQ ID NO: 7966

SEQ ID NO: 7971 - protein, 802 aa, Homo sapiens
LLPERMSGVSEPLSRVKLGTLRRPEGPAEPMVVVPVDVEKEDVRILKVCFYSNSFNPGKNFKLVKCTVQTEIREIITSILLSGRIGPNIRLAECYGLRLKHMKSDEIHWLHPQMTVGEVQDKYECLHVEAEWRYDLQIRYLPEDFMESLKEDRTTLLYFYQQLRNDYMQRYASKVSEGMALQLGCLELRRFFKDMPHNALDKKSNFELLEKEVGLDLFFPKQMQENLKPKQFRKMIQQTFQQYASLREEECVMKFFNTLAGFANIDQETYRCELIQGWNITVDLVIGPKGIRQLTSQDAKPTCLAEFKQIRSIRCLPLEEGQAVLQLGIEGAPQALSIKTSSLAEAENMADLIDGYCRLQGEHQGSLIIHPRKDGEKRNSLPQIPMLNLEARRSHLSESCSIESDIYAEIPDETLRRPGGPQYGIAREDVVLNRILGEGFFGEVYEGVYTNHKGEKINVAVKTCKKDCTLDNKEKFMSEAVIMKNLDHPHIVKLIGIIEEEPTWIIMELYPYGELGHYLERNKNSLKVLTLVLYSLQICKAMAYLESINCVHRDIAVRNILVASPECVKLGDFGLSRYIEDEDYYKASVTRLPIKWMSPESINFRRFTTASDVWMFAVCMWEILSFGKQPFFWLENKDVIGVLEKGDRLPKPDLCPPVLYTLMTRCWDYDPSDRPRFTELVCSLSDVYQMEKDIAMEQERNARYRTPKILEPTAFQEPPPKPSRPKYRPPPQTNLLAPKLQFQVPEGLCASSPTLTSPMEYPSPVNSLHTPPLHRHNVFKRHSMREEDFIQPSSRGPAAVGG

SEQ ID NO: 7972 - protein, 1009 aa, Homo sapiens; identical to SEQ ID NO: 7967

SEQ ID NO: 7973 - protein, 322 aa, Homo sapiens
MADRDSGSEQGGAALGSGGSLGHPGSGSGSGGGGGGGGGGGGSGGGGGGAPGGLQHETQELASKRVDIQNKRFYLDVKQNAKGRFLKIAEVGAGGNKSRLTLSMSVAVEFRDYLGDFIEHYAQLGPSQPPDLAQAQDEPRRALKSEFLVRENRKYYMDLKENQRGRFLRIRQTVNRGPGLGSTQGQTIALPAQGLIEFRDALAKLIDDYGVEEEPAELPEGTSLTVDNKRFFFDVGSNKYGVFMRVSEVKPTYRNSITVPYKVWAKFGHTFCKYSEEMKKIQEKQREKRAACEQLHQQQQQQQEETAAATLLLQGEEEGEED

SEQ ID NO: 7974 - protein, 195 aa, Homo sapiens
MGRARDAILDALENLTAEELKKFKLKLLSVPLREGYGRIPRGALLSMDALDLTDKLVSFYLETYGAELTANVLRDMGLQEMAGQLQAATHQGSGAAPAGIQAPPQSAAKPGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 7975 - protein, 176 aa, Homo sapiens
MGRARDAILDALENLTAEELKKFKLKLLSVPLREGYGRIPRGALLSMDALDLTDKLVSFYLETYGAELTANVLRDMGLQEMAGQLQAATHQGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 7976 - protein, 135 aa, Homo sapiens
MGRARDAILDALENLTAEELKKFKLQAATHQGSGAAPAGIQAPPQSAAKPGLHFIDQHRAALIARVTNVEWLLDALYGKVLTDEQYQAVRAEPTNPSKMRKLFSFTPAWNWTCKDLLLQALRESQSYLVEDLERS

SEQ ID NO: 7977 - protein, 436 aa, Homo sapiens
MRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 7978 - protein, 456 aa, Homo sapiens
MRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYERPRRTWLQVSSLCCMACKMIFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 7979 - protein, 436 aa, Homo sapiens; identical to SEQ ID NO: 7977

SEQ ID NO: 7980 - protein, 360 aa, Homo sapiens
MFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 7981 - protein, 281 aa, Homo sapiens
MAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 7982 - protein, 343 aa, Homo sapiens
MKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 7983 - protein, 407 aa, Homo sapiens
MRWVWALLKNASLAGAPKYIEHFSKFSPSPLSMKQFLDFGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 7984 - protein, 282 aa, Homo sapiens
MPLLTQQIQDEDDQYSLVASLDNVRNLSTILKAIHFREHATCFATKNGIKVTVENAKCVQANAFIQAGIFQEFKVQEESVTFRINLTVLLDCLSIFGSSPMPGTLTALRMCYQGYGYPLMLFLEEGGVVTVCKINTQEPEETLDFDFCSTNVINKIILQSEGLREAFSELDMTSEVLQITMSPDKPYFRLSTFGNAGSSHLDYPKDSDLMEAFHCNQTQVNRYKISLLKPSTKALVLSCKVSIRTDNRGFLSLQYMIRNEDGQICFVEYYCCPDEEVPESES

SEQ ID NO: 7985 - protein, 282 aa, Homo sapiens; identical to SEQ ID NO: 7984

SEQ ID NO: 7986 - protein, 246 aa, Homo sapiens
MPLLTQQIQDEDDQYSLVASLDNVRNLSTILKAIHFREHATCFATKNGIKVTVENAKCVQANAFIQGTLTALRMCYQGYGYPLMLFLEEGGVVTVCKINTQEPEETLDFDFCSTNVINKIILQSEGLREAFSELDMTSEVLQITMSPDKPYFRLSTFGNAGSSHLDYPKDSDLMEAFHCNQTQVNRYKISLLKPSTKALVLSCKVSIRTDNRGFLSLQYMIRNEDGQICFVEYYCCPDEEVPESES

SEQ ID NO: 7987 - protein, 584 aa, Homo sapiens
MNQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 7988 - protein, 670 aa, Homo sapiens
MNQVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 7989 - protein, 670 aa, Homo sapiens; identical to SEQ ID NO: 7988

SEQ ID NO: 7990 - protein, 670 aa, Homo sapiens; identical to SEQ ID NO: 7988

SEQ ID NO: 7991 - protein, 670 aa, Homo sapiens; identical to SEQ ID NO: 7988

SEQ ID NO: 7992 - protein, 505 aa, Homo sapiens
MFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 7993 - protein, 670 aa, Homo sapiens; identical to SEQ ID NO: 7988

SEQ ID NO: 7994 - protein, 681 aa, Homo sapiens
MSKTFLRPKVSSTKVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNTESSFHMFPYQSQIAVFKEFLLRATKYNKLQMLGDDLRTDKKIILVEDLPNQFYRDSHTLHEVLRKYVRIGRCPLIFIISDSLSGDNNQRLLFPKEIQEECSISNISFNPVAPTIMMKFLNRIVTIEANKNGGKITVPDKTSLELLCQGCSGDIRSAINSLQFSSSKGENNLRPRKKGMSLKSDAVLSKSKRRKKPDRVFENQEVQAIGGKDVSLFLFRALGKILYCKRASLTELDSPRLPSHLSEYERDTLLVEPEEVVEMSHMPGDLFNLYLHQNYIDFFMEIDDIVRASEFLSFADILSGDWNTRSLLREYSTSIATRGVMHSNKARGYAHCQGGGSSFRPLHKPQWFLINKKYRENCLAAKALFPDFCLPALCLQTQLLPYLALLTIPMRNQAQISFIQDIGRLPLKRHFGRLKMEALTDREHGMIDPDSGDEAQLNGGHSAEESLGEPTQATVPETWSLPLSQNSASELPASQPQPFSAQGDMEENIIIEDYESDGT

SEQ ID NO: 7995 - protein, 169 aa, Homo sapiens
MNQVTDWVDPSFDDFLECSGVSTITATSLGVNNSSHRRKNGPSTLESSRFPARKRGNLSSLEQIYGLENSKEYLSENEPWVDKYKPETQHELAVHKKKIEEVETWLKAQVLERQPKQGGSILLITGPPGCGKTTTLKILSKEHGIQVQEWINPVLPDFQKDDFKGMFNT

SEQ ID NO: 7996 - protein, 21 aa, Homo sapiens
MNQVTDWVDPSFDDFLECSGV

SEQ ID NO: 7997 - protein, 681 aa, Homo sapiens; identical to SEQ ID NO: 7994

SEQ ID NO: 7998 - protein, 505 aa, Homo sapiens; identical to SEQ ID NO: 7992

SEQ ID NO: 7999 - protein, 495 aa, Homo sapiens
MDSLAESRWPPGLAVMKTIDDLLRCGICFEYFNIAMIIPQCSHNYCSLCIRKFLSYKTQCPTCCVTVTEPDLKNNRILDELVKSLNFARNHLLQFALESPAKSPASSSSKNLAVKVYTPVASRQSLKQGSRLMDNFLIREMSGSTSELLIKENKSKFSPQKEASPAAKTKETRSVEEIAPDPSEAKRPEPPSTSTLKQVTKVDCPVCGVNIPESHINKHLDSCLSREEKKESLRSSVHKRKPLPKTVYNLLSDRDLKKKLKEHGLSIQGNKQQLIKRHQEFVHMYNAQCDALHPKSAAEIVREIENIEKTRMRLEASKLNESVMVFTKDQTEKEIDEIHSKYRKKHKSEFQLLVDQARKGYKKIAGMSQKTVTITKEDESTEKLSSVCMGQEDNMTSVTNHFSQSKLDSPEELEPDREEDSSSCIDIQEVLSSSESDSCNSSSSDIIRDLLEEEEAWEASHKNDLQDTEISPRQNRRTRAAESAEIEPRNKRNRN

SEQ ID NO: 8000 - protein, 92 aa, Homo sapiens
MDSLAESRWPPGLAVMKTIDDLLRCGICFEYFNIAMIIPQCSHNYCSLCIRKFLSYKTQCPTCCVTVTEPDLKNNRILDELVKSLNFARNHL

SEQ ID NO: 8001 - protein, 363 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 8002 - protein, 198 aa, Homo sapiens
MLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 8003 - protein, 363 aa, Homo sapiens; identical to SEQ ID NO: 8001

SEQ ID NO: 8004 - protein, 308 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQLKALGFPESLVIQAYFACEKNENLAANFLLSQNFDDE

SEQ ID NO: 8005 - protein, 409 aa, Homo sapiens
MQVTLKTLQQQTFKIDIDPEETVKALKEKIESEKGKDAFPVAGQKLIYAGKILNDDTALKEYKIDEKNFVVVMVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMGIPGDRESQAVVDPPQAASTGAPQSSAVAAAAATTTATTTTTSSGGHPLEFLRNQPQFQQMRQIIQQNPSLLPALLQQIGRENPQLLQQISQHQEHFIQMLNEPVQEAGGQGGGGGGGSGGIAEAGSGHMNYIQVTPQEKEAIERLKALGFPEGLVIQAYFACEKNENLAANFLLQQNFDED

SEQ ID NO: 8006 - protein, 172 aa, Homo sapiens
MVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMIIVKTGNKKKKQPLLGK

SEQ ID NO: 8007 - protein, 337 aa, Homo sapiens
MVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMGIPGDRESQAVVDPPQAASTGAPQSSAVAAAAATTTATTTTTSSGGHPLEFLRNQPQFQQMRQIIQQNPSLLPALLQQIGRENPQLLQQISQHQEHFIQMLNEPVQEAGGQGGGGGGGSGGIAEAGSGHMNYIQVTPQEKEAIERLKALGFPEGLVIQAYFACEKNENLAANFLLQQNFDED

SEQ ID NO: 8008 - protein, 146 aa, Homo sapiens
MQVTLKTLQQQTFKIDIDPEETVKALKEKIESEKGKDAFPVAGQKLIYAGKILNDDTALKEYKIDEKNFVVVMVTKPKAVSTPAPATTQQSAPASTTAVTSSTTTTVAQAPTPVPALAPTSTPASITPASATASSEPAPASAAKQE

SEQ ID NO: 8009 - protein, 80 aa, Homo sapiens
MVKALKEKIESEKGKDAFPVAGQKLIYAGKILNDDTALKEYKIDEKNFVVVMVTKPKAVSTPAPATTQQSAPASTTAVTS

SEQ ID NO: 8010 - protein, 114 aa, Homo sapiens
  MOD_RES (1)..(1): Any amino acid
XTASSEPAPASAAKQEKPAEKPAETPVATSPTATDSTSGDSSRSNLFEDATSALVTGQSYENMVTEIMSMGYEREQVIAALRASFNNPDRAVEYLLMIIVKTGNKKKKQPLLGK

SEQ ID NO: 8011 - protein, 1312 aa, Homo sapiens
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 8012 - protein, 1173 aa, Homo sapiens
MISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 8013 - protein, 339 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 8014 - protein, 242 aa, Homo sapiens
MAMQMQLEANADTSVEEESFGPQPISRLEQCGINANDVKKLEEAGFHTVEAVAYAPKKELINIKGISEAKADKILLLSHRYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 8015 - protein, 340 aa, Homo sapiens
MAMQMQLEANADTSVEEESFGPQPISRLEQCGINANDVKKLEEAGFHTVEAVAYAPKKELINIKGISEAKADKILTESRSVARLECNSVILVYCTLRLSGSSDSPASASRVVGTTGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 8016 - protein, 280 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEIVSEERKRGNQNLQNLRLSLSS

SEQ ID NO: 8017 - protein, 151 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQVWSLWQ

SEQ ID NO: 8018 - protein, 75 aa, Homo sapiens
MAMQMQLEANADTSVEEESFGPQPISRLEQCGINANDVKKLEEAGFHTVEAVAYAPKKELINIKGISEAKADKIL

SEQ ID NO: 8019 - protein, 172 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLL

SEQ ID NO: 8020 - protein, 100 aa, Homo sapiens
MAMQMQLEANADTSVEEESFGPQPISRLEQCGINANDVKKLEEAGFHTVEAVAYAPKKELINIKGISEAKADKILVELRLDLSQKCLENSELGRPRSVIR

SEQ ID NO: 8021 - protein, 340 aa, Homo sapiens; identical to SEQ ID NO: 8015

SEQ ID NO: 8022 - protein, 242 aa, Homo sapiens
MAMQMQLEANADTSVEEESFGPQPISRLEQCGINANDVKKLEEAGFHTVEAVAYAPKKELINIKGISEAKADKILAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 8023 - protein, 350 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQAYAQC

SEQ ID NO: 8024 - protein, 366 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQEFWHICISGFSIQNRLKENES

SEQ ID NO: 8025 - protein, 350 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQGQETP

SEQ ID NO: 8026 - protein, 350 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQGQEKP

SEQ ID NO: 8027 - protein, 133 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGG

SEQ ID NO: 8028 - protein, 384 aa, Homo sapiens
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQETTFCSVTQAELNWAPEILPPQPPEQLGLQMCHHTQLIF

SEQ ID NO: 8029 - protein, 366 aa, Homo sapiens; identical to SEQ ID NO: 8024

SEQ ID NO: 8030 - protein, 75 aa, Homo sapiens
MGSKKLKRVGLSQELCDRLSRHQILTCQDFLCLSPLELMKVTGLSYRGVHELLCMVSRACAPKMQTAYGIKAQRS

SEQ ID NO: 8031 - protein, 376 aa, Homo sapiens
MRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLCMQLAVDVQIPECFGGVAGEAVFIDTEGSFMVDRVVDLATACIQHLQLIAEKHKGEEHRKALEDFTLDNILSHIYYFRCRDYTELLAQVYLLPDFLSEHSKVRLVIVDGIAFPFRHDLDDLSLRTRLLNGLAQQMISLANNHRLAVILTNQMTTKIDRNQALLVPALGESWGHAATIRLIFHWDRKQRLATLYKSPSQKECTVLFQIKPQGFRDTVVTSACSLQTEGSLSTRKRSRDPEEEL

SEQ ID NO: 8032 - protein, 328 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGRIRLSGNARWLMPKVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 8033 - protein, 328 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGSLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 8034 - protein, 216 aa, Homo sapiens
MGVLRVGLCPGLTEEMIQLLRSHRIKTVVDLVSADLEEVAQKCGLSYKAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 8035 - protein, 118 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGRHGGRTQVGTWEDCSCLRSPQGDRGVGSGML

SEQ ID NO: 8036 - protein, 283 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGSLDKLLDAGLYTGEVTEIVGGPGSGKTQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 8037 - protein, 348 aa, Homo sapiens
MGVLRVGLCPGLTEEMIQLLRSHRIKTVVDLVSADLEEVAQKCGLSYKTWRAHSSGNLGGLQLPQVPAGRSWSGVRNALKKAGLGHGGTDGLSLNAFDERGTAVSTSRLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKTLARDLGMAVVVTNHITRDRDSGRLKPALGRSWSFVPSTRILLDTIEGAGASGGRRMACLAKSSRQPTGFQEMVDIGTWGTSEQSATLQGDQT

SEQ ID NO: 8038 - protein, 215 aa, Homo sapiens
MVMAALPFSEDLKMPDTCVLPHCPGKENKDVVDLVSADLEEVAQKCGLSYKALVALRRVLLAQFSAFPVNGADLYEELKTSTAILSTGIGSLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQDGIPEHLNHIPHCLHVHLPC

SEQ ID NO: 8039 - protein, 236 aa, Homo sapiens
MGVLRVGLCPGLTEEMIQLLRSHRIKTVVDLVSADLEEVAQKCGLSYKALVALRRVLLAQFSAFPVNGADLYEELKTSTAILSTGIGSLDKLLDAGLYTGEVTEIVGGPGSGKTQVCLCMAANVAHGLQQNVLYVDSNGGLTASRLLQLLQAKTQDEEEQAEALRRIQVVHAFDIFQMLDVLQELRGTVAQQVTGSSGTVKVVVVDSVTAVVSPLLGGQQREGLALMMQLARELKT

SEQ ID NO: 8040 - protein, 348 aa, Homo sapiens; identical to SEQ ID NO: 8037

SEQ ID NO: 8041 - protein, 418 aa, Homo sapiens
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRSFGNALGNCILDKDYLRSLNKLPRQLPLEVDLTKAKRQDLEPSVEEARYNSCRPNMALGHPQLQQVTSPSRPSHAVIPADQDCSSRSLSSSAVESEATHQRKLRQKQLQQQFRERMEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 8042 - protein, 418 aa, Homo sapiens; identical to SEQ ID NO: 8041

SEQ ID NO: 8043 - protein, 341 aa, Homo sapiens
MFGYNGWAHSITQQNVDFVDLNNGKFYVGVCAFVRVQLKDGSYHEDVGYGVSEGLKSKALSLEKARKEAVTDGLKRALRSFGNALGNCILDKDYLRSLNKLPRQLPLEVDLTKAKRQDLEPSVEEARYNSCRPNMALGHPQLQQVTSPSRPSHAVIPADQDCSSRSLSSSAVESEATHQRKLRQKQLQQQFRERMEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 8044 - protein, 226 aa, Homo sapiens
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRLPLLGVSGRILYSLFSVHSVMCAGGLPTPTASAQTAPSSPCSSAVLRYAQEFWECTWKLYSGQRLPEITK

SEQ ID NO: 8045 - protein, 747 aa, Homo sapiens
MRRSLAPSQLAKRKPEGRSCDDEDWQPGLVTPRKRKSSSETQIQECFLSPFRKPLSQLTNQPPCLDSSQHEAFIRSILSKPFKVPIPNYQGPLGSRALGLKRAGVRRALHDPLEKDALVLYEPPPLSAHDQLKLDKEKLPVHVVVDPILSKVLRPHQREGVKFLWECVTSRRIPGSHGCIMADEMGLGKTLQCITLMWTLLRQSPECKPEIDKAVVVSPSSLVKNWYNEVGKWLGGRIQPLAIDGGSKDEIDQKLEGFMNQRGARVSSPILIISYETFRLHVGVLQKGSVGLVICDEGHRLKNSENQTYQALDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLRQAKPAEELLEGKMSVSSLSSITSLKKLCNHPALIYDKCVEEEDGFVGALDLFPPGYSSKALEPQLSGKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 8046 - protein, 747 aa, Homo sapiens; identical to SEQ ID NO: 8045

SEQ ID NO: 8047 - protein, 567 aa, Homo sapiens
MADEMGLGKTLQCITLMWTLLRQSPECKPEIDKAVVVSPSSLVKNWYNEVGKWLGGRIQPLAIDGGSKDEIDQKLEGFMNQRGARVSSPILIISYETFRLHVGVLQKGSVGLVICDEGHRLKNSENQTYQALDSLNTSRRVLISGTPIQNDLLEYFSLVHFVNSGILGTAHEFKKHFELPILKGRDAAASEADRQLGEERLRELTSIVNRCLIRRTSDILSKYLPVKIEQVVCCRLTPLQTELYKRFLRQAKPAEELLEGKMSVSSLSSITSLKKLCNHPALIYDKCVEEEDGFVGALDLFPPGYSSKALEPQLSGKMLVLDYILAVTRSRSSDKVVLVSNYTQTLDLFEKLCRARRYLYVRLDGTMSIKKRAKVVERFNSPSSPDFVFMLSSKAGGCGLNLIGANRLVMFDPDWNPANDEQAMARVWRDGQKKTCYIYRLLSAGTIEEKIFQRQSHKKALSSCVVDEEQDVERHFSLGELKELFILDEASLSDTHDRLHCRRCVNSRQIRPPPDGSDCTSDLAGWNHCTDKWGLRDEVLQAAWDAASTAITFVFHQRSHEEQRGLR

SEQ ID NO: 8048 - protein, 391 aa, Homo sapiens
MKCLVTGGNVKVLGKAVHSLSRIGDELYLEPLEDGLSLRTVNSSRSAYACFLFAPLFFQQYQAATPGQDLLRCKILMKSFLSVFRSLAMLEKTVEKCCISLNGRSSRLVVQLHCKFGVRKTHNLSFQDCESLQAVFDPASCPHMLRAPARVLGEAVLPFSPALAEVTLGIGRGRRVILRSYHEEEADSTAKAMVTEMCLGEEDFQQLQAQEGVAITFCLKEFRGLLSFAESANLNLSIHFDAPGRPAIFTIKDSLLDGHFVLATLSDTDSHSQDLGSPERHQPVPQLQAHSTPHPDDFANDDIDSYMIAMETTIGNEGSRVLPSISLSPGPQPPKSPGPHSEEEDEAEPSTVPGTPPPKKFRSLFFGSILAPVRSPQGPSPVLAEDSEGEG

SEQ ID NO: 8049 - protein, 583 aa, Homo sapiens
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 8050 - protein, 604 aa, Homo sapiens
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAMWGPKLYALFQMRSCQSSIKQM

SEQ ID NO: 8051 - protein, 339 aa, Homo sapiens
PHPKINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERSRLSKIKKKKRKKKKKKKK

SEQ ID NO: 8052 - protein, 604 aa, Homo sapiens; identical to SEQ ID NO: 8050

SEQ ID NO: 8053 - protein, 257 aa, Homo sapiens
MERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAMWGPKLYALFQMRSCQSSIKQM

SEQ ID NO: 8054 - protein, 253 aa, Homo sapiens
GGRIARAHEFEAAVSFCTSAWATERDPVSRKQRELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 8055 - protein, 200 aa, Homo sapiens
MPKPINVRVTTMDAELEFAIQPNTTGKQLFDQVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQDETKKTQNDVLHAENVKAGRDKYKTLRQIRQGNTKQRIDEFEAMWGPKLYALFQMRSCQSSIKQM

SEQ ID NO: 8056 - protein, 604 aa, Homo sapiens; identical to SEQ ID NO: 8050

SEQ ID NO: 8057 - protein, 447 aa, Homo sapiens
MLSWNLPFSPIQLANNFLTSVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 8058 - protein, 1077 aa, Homo sapiens
MDTDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 8059 - protein, 1055 aa, Homo sapiens
MSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLASCAASSFSSVSHCVQQTKVAFTPEDGSAAQGLSVSVSNSFLSRHGSLPVPSEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 8060 - protein, 1094 aa, Homo sapiens
MSGGLGLRRSPEMSGKIEKADSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 8061 - protein, 1077 aa, Homo sapiens; identical to SEQ ID NO: 8058

SEQ ID NO: 8062 - protein, 1095 aa, Homo sapiens
MGNAIEKQKPLKRSHLYPWKQDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 8063 - protein, 464 aa, Homo sapiens
MSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLQASCAASSFSSVSHCVQQTKVAFTPEDGSAAQGLSVSVSNSFLSRHGSLPVPSYKSVFRSYSQDFVPHHQASVPPFLPPTSSSSPHFPPAHQSQSSDLAVPTMAGPPPSTVDGPLSASQESSFHGNTVCLPSETSFTDSEPPAGKDGHPRD

SEQ ID NO: 8064 - protein, 1094 aa, Homo sapiens; identical to SEQ ID NO: 8060

SEQ ID NO: 8065 - protein, 336 aa, Homo sapiens
MEVYGFSDSFSGVDSVQELAPPPALPPKQRQLSENASEEAGEGEYVNLYSSGQSSEELAPSRGEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSY

SEQ ID NO: 8066 - protein, 1057 aa, Homo sapiens
MGNAIEKQKPLKRSHLYPWKQDSQRSHLSSFTMKLMDKFHSPKIKRTPSKKGKPAEVSVKIPEKPVNKNLSWLEEKEKEVVSALRYFKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 8067 - protein, 319 aa, Homo sapiens
  MOD_RES (1)..(1): Any amino acid
XLAPPPALPPKQRQLSENASEEAGEGEYVNLYSSGQSSEELAPSRGEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSY

SEQ ID NO: 8068 - protein, 228 aa, Homo sapiens
  MOD_RES (1)..(1): Any amino acid
XLPEKKNKHMLAYMQLLEDYSEPQPSMFYQTPQNEHIYQQKNKLLMEVYGFSDSFSGVDSVQELAPPPALPPKQRQLQASCAASSFSSVSHCVQQTKVAFTPEDGSAAQGLSVSVSNSFLSRHGSLPVPSYKSVFRSYSQDFVPHHQASVPPFLPPTSSSSPHFPPAHQSQSSDLAVPTMAGPPPSTVDGPLSASQESSFHGNTVCLPSETSFTDSEPPAGKDGHPRD

SEQ ID NO: 8069 - protein, 193 aa, Homo sapiens
MGNAIEKQKPLKRSHLYPWKQDSQRSHLSSFTMKLMDKFHSPKIKRTPSKKGKPAEVSVKIPEKPVNKEATDRFLPEGYPLPLDLEQQAVEFMSTSAVASRSQRQKNLSWLEEKEKEVVSALRYFKTIVDKMAIDKKVLEMLPGSASKVLEAILPLVQNDPRIQHSSALSSCYSRVYQSLANLIRWSDQVMLE

SEQ ID NO: 8070 - protein, 1023 aa, Homo sapiens
FKTIVDKMAIDKKVLEMLPGSASKVLEAILPLVQNDPRIQHSSALSSCYSRVYQSLANLIRWSDQVMLEGVNSEDKEMVTTVKGVIKAVLDGVKELVRLTIEKQGRPSPTSPVKPSSPASKPDGPAELPLTDREVEILNKTTGMSQSTELLPDATDEEVAPPKPPLPGIRVVDNSPPPALPPKKRQSAPSPTRVAVVAPMSRATSGSSLPVGINRQDFDVDCYAQRRLSGGSHSYGGESPRLSPCSSIGKLSKSDEQLSSLDRDSGQCSRNTSCETLDHYDPDYEFLQQDLSNADQIPQQTAWNLSPLPESLGESGSPFLGPPFQLPLGGHPQPDGPLAPGQQTDTPPALPEKKRRSAASQTADGSGCRVSYERHPSQYDNISGEDLQSTAPIPSVPYAPFAAILPFQHGGSSAPVEFVGDFTAPESTGDPEKPPPLPEKKNKHMLAYMQLLEDYSEPQPSMFYQTPQNEHIYQQKNKLLMEVYGFSDSFSGVDSVQELAPPPALPPKQRQLASCAASSFSSVSHCVQQTKVAFTPEDGSAAQGLSVSVSNSFLSRHGSLPVPSEPPAGKDGHPRDPSAVSGVPGKDSRDGSERAPKSPDALESAQSEEEVDELSLIDHNEIMSRLTLKQEGDDGPDVRGGSGDILLVHATETDRKDLVLYCEAFLTTYRTFISPEELIKKLQYRYEKFSPFADTFKKRVSKNTFFVLVRVVDELCLVELTEEILKLLMELVFRLVCNGELSLARVLRKNILDKVDQKKLLRCATSSQPLAARGVAARPGTLHDFHSHEIAEQLTLLDAELFYKIEIPEVLLWAKEQNEEKSPNLTQFTEHFNNMSYWVRSIIMLQEKAQDRERLLLKFIKIMKHLRKLNNFNSYLAILSALDSAPIRRLEWQKQTSEGLAEYCTLIDSSSSFRAYRAALSEVEPPCIPYLGLILQDLTFVHLGNPDYIDGKVNFSKRWQQFNILDSMRCFQQAHYDMRRNDDIINFFNDFSDHLAEEALWELSLKIKPRNITRRKTDREEKT

SEQ ID NO: 8071 - protein, 159 aa, Homo sapiens
MEVYGFSDSFSGVDSVQELAPPPALPPKQRQLYKSVFRSYSQDFVPHHQASVPPFLPPTSSSSPHFPPAHQSQSSDLAVPTMAGPPPSTVDGPLSASQESSFHGNTVCLPSETSFTDSEPPAGKDGHPRDPSAVSGVPGKDSRDGSERAPKSPDALESA

SEQ ID NO: 8072 - protein, 231 aa, Homo sapiens
MEVYGFSDSFSGVDSVQELAPPPALPPKQRQLQASCAASSFSSVSHCVQQTKVAFTPEDGSAAQGLSVSVSNSFLSRHGSLPVPSYKSVFRSYSQDFVPHHQASVPPFLPPTSSSSPHFPPAHQSQSSDLAVPTMAGPPPSTVDGPLSASQESSFHGNTVCLPSETSFTDSSENASEEAGEGEYVNLYSSGQSSEELAPSRGEPPAGKDGHPRDPSAVSGVPGKDSRDGSE

SEQ ID NO: 8073 - protein, 158 aa, Homo sapiens
MSGGLGLRRSPEMSGKIEKADSQRSHLSSFTMKLMDKFHSPKIKRTPSKKGKPAEVSVKIPEKPVNKNLSWLEEKEKEVVSALRYFKTIVDKMAIDKKVLEMLPGSASKVLEAILPLVQNDPRIQHSSALSSCYSRVYQSLANLIRWSDQVMLEGVNS

SEQ ID NO: 8074 - protein, 86 aa, Homo sapiens
MEVYGFSDSFSGVDSVQELAPPPALPPKQRQLEPPAGKDGHPRDPSAVSGVPGKDSRDGSESGITSVYRWNIQRQQRLSYGHTASQ

SEQ ID NO: 8075 - protein, 2472 aa, Homo sapiens
MTARGQSPLAPLLETLEDPSASHGGQTDAYLTLTSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNNEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKHNTTSAKGFLSPGSRSPKFKSSKKCLISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLLAQISALALQLDSEDLHNYSGSQLFEMHEKLSCMANSVIKNLQSRWRSPSHENSI

SEQ ID NO: 8076 - protein, 87 aa, Homo sapiens
MTARGQSPLAPLLETLEDPSASHGGQTDAYLTLTSRMTGEEGKEVITEIEKKLPRLYKVLKTHISSQNSELSSAALQALGFCLYNPK

SEQ ID NO: 8077 - protein, 2446 aa, Homo sapiens
MTARGQSPLAPLLETLEDPSASHGGQTDAYLTLTSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNNEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLLAQISALALQLDSEDLHNYSGSQLFEMHEKLSCMANSVIKNLQSRWRSPSHENSI

SEQ ID NO: 8078 - protein, 2446 aa, Homo sapiens; identical to SEQ ID NO: 8077

SEQ ID NO: 8079 - protein, 341 aa, Homo sapiens
MTARGQSPLAPLLETLEDPSASHGGQTDAYLTLTSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVLPPRTEPRELPE

SEQ ID NO: 8080 - protein, 2472 aa, Homo sapiens; identical to SEQ ID NO: 8075

SEQ ID NO: 8081 - protein, 2446 aa, Homo sapiens; identical to SEQ ID NO: 8077

SEQ ID NO: 8082 - protein, 184 aa, Homo sapiens
MREYKLVVLGSGGVGKSALTVQFVQGIFVEKYDPTIEDSYRKQVEVDCQQCMLEILDTAGTEQFTAMRDLYMKNGQGFALVYSITAQSTFNDLQDLREQILRVKDTEDVPMILVGNKCDLEDERVVGKEQGQNLARQWCNCAFLESSAKSKINVNEIFYDLVRQINRKTPVEKKKPKKKSCLLL

SEQ ID NO: 8083 - protein, 184 aa, Homo sapiens; identical to SEQ ID NO: 8082

SEQ ID NO: 8084 - protein, 129 aa, Homo sapiens
MREYKLVVLGSGGVGKSALTVQFVQGIFVEKYDPTIEDSYRKQVEVDCQQCMLEILDTAGTEQFTAMRDLYMKNGQGFALVYSITAQSTFNDLQDLREQILRVKDTEDVPMILVGNKCDLEDERVVGKE

SEQ ID NO: 8085 - protein, 184 aa, Homo sapiens; identical to SEQ ID NO: 8082

SEQ ID NO: 8086 - protein, 184 aa, Homo sapiens; identical to SEQ ID NO: 8082

SEQ ID NO: 8087 - protein, 459 aa, Homo sapiens
MRAQIEVIPCKICGDKSSGIHYGVITCEGCKGFFRRSQQNNASYSCPRQRNCLIDRTNRNRCQHCRLQKCLALGMSRDAVKFGRMSKKQRDSLYAEVQKHQQRLQEQRQQQSGEAEALARVYSSSISNGLSNLNNETSGTYANGHVIDLPKSEGYYNVDSGQPSPDQSGLDMTGIKQIKQEPIYDLTSVPNLFTYSSFNNGQLAPGITMTEIDRIAQNIIKSHLETCQYTMEELHQLAWQTHTYEEIKAYQSKSREALWQQCAIQITHAIQYVVEFAKRITGFMELCQNDQILLLKSGCLEVVLVRMCRAFNPLNNTVLFEGKYGGMQMFKALGSDDLVNEAFDFAKNLCSLQLTEEEIALFSSAVLISPDRAWLIEPRKVQKLQEKIYFALQHVIQKNHLDDETLAKLIAKIPTITAVCNLHGEKLQVFKQSHPEIVNTLFPPLYKELFNPDCATGCK

SEQ ID NO: 8088 - protein, 470 aa, Homo sapiens
MCENQLKTKADATAQIEVIPCKICGDKSSGIHYGVITCEGCKGFFRRSQQNNASYSCPRQRNCLIDRTNRNRCQHCRLQKCLALGMSRDAVKFGRMSKKQRDSLYAEVQKHQQRLQEQRQQQSGEAEALARVYSSSISNGLSNLNNETSGTYANGHVIDLPKSEGYYNVDSGQPSPDQSGLDMTGIKQIKQEPIYDLTSVPNLFTYSSFNNGQLAPGITMTEIDRIAQNIIKSHLETCQYTMEELHQLAWQTHTYEEIKAYQSKSREALWQQCAIQITHAIQYVVEFAKRITGFMELCQNDQILLLKSGCLEVVLVRMCRAFNPLNNTVLFEGKYGGMQMFKALGSDDLVNEAFDFAKNLCSLQLTEEEIALFSSAVLISPDRAWLIEPRKVQKLQEKIYFALQHVIQKNHLDDETLAKLIAKIPTITAVCNLHGEKLQVFKQSHPEIVNTLFPPLYKELFNPDCATGCK

SEQ ID NO: 8089 - protein, 270 aa, Homo sapiens
MGEAEAPSFEMTWSSTTSSGYCSQEDSDSELEQYFTARTSLARRPRRDQDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 8090 - protein, 344 aa, Homo sapiens
MSGEPELIELRELAPAGRAGKGRTRLERANALRIARGTACNPTRQLVPGRGHRFQPAGPATHTWCDLCGDFIWGVVRKGLQCARLSADCKFTCHYRCRALVCLDCCGPRDLGWEPAVERDTNVDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 8091 - protein, 340 aa, Homo sapiens
MSGEPELIELRELAPAGRAGKGRTRLERANALRIARGTACNPTRQLVPGRGHRFQPAGPATHTWCDLCGDFIWGVVRKGLQCAHCKFTCHYRCRALVCLDCCGPRDLGWEPAVERDTNVDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 8092 - protein, 189 aa, Homo sapiens
MSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 8093 - protein, 326 aa, Homo sapiens
MDYSHQTSLVPCGQDKYISKNELLLHLKTYNLYYEGQNLQLRHREEEDEFIVEGLLNISWGLRRPIRLQMQDDNERIRPPPSSSSWHSGCNLGAQGTTLKPLTVPKVQISEVDAPPEGDQMPSSTDSRGLKPLQEDTPQLMRTRSDVGVRRRGNVRTPSDQRRIRRHRFSINGHFYNHKTSVFTPAYGSVTNVRINSTMTTPQVLKLLLNKFKIENSAEEFALYVVHTSGEKQKLKATDYPLIARILQGPCEQISKVFLMEKDQVEEVTYDVAQYIKFEMPVLKSFIQKLQEEEDREVKKLMRKYTVLRLMIRQRLEEIAETPATI

SEQ ID NO: 8094 - protein, 326 aa, Homo sapiens; identical to SEQ ID NO: 8093

SEQ ID NO: 8095 - protein, 330 aa, Homo sapiens
MKEDCLPSSHVPISDSKSIQKRDVQGLSEEGTLIIEGLLNIAWGLRRPIRLQMQDDREQVHLPSTSWMPRRPSCPLGCWSLLLGLSSLSLPAAISALQLSVFRKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 8096 - protein, 321 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 8097 - protein, 412 aa, Homo sapiens
GSNAGGGQGGCQGLTCDSESVGTLDILDQTQACPVSLASSSARPPCPPPGPCAEPSGCIAMAVWSPLVMPGRREGCCHTPVTNEETEAREAKGQKLRPCHTLGVHVCLSLFRSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 8098 - protein, 130 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLHLAGKKGRLQPGGLPTPMQAEHVSPSLVLSLKFTRI

SEQ ID NO: 8099 - protein, 126 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLAPGGGRGGPPADADQERRQLHEPEEAQVPRPR

SEQ ID NO: 8100 - protein, 151 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLGCWSLLLGLSSLSLPAAISALQLSVFRKEPSPQNGNITAQGPSIQPVHKAESSTDSS

SEQ ID NO: 8101 - protein, 123 aa, Homo sapiens
SSHVPISDSKSIQKSELLGLLKTYNCYHEGKSFQLRHREEEGTLIIEGLLNIAWGLRRPIRLQMQDDREQVHLPSTSWMPRRPSCPLHLAGKKGRLQPGGLPTPMQAEHVSPSLVLSLKFTRI

SEQ ID NO: 8102 - protein, 265 aa, Homo sapiens
MTVDSSMSSGYCSLDEELEDCFFTAKTTFFRNAQSKHLSKNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEWDAFSIPELQNFLTILEKEEQDKIQQVQKKYDKFRQKLEEALRESQGKPG

SEQ ID NO: 8103 - protein, 392 aa, Homo sapiens [sequence omitted]

SEQ ID NO: 8104 - protein, 418 aa, Homo sapiens
MAMASPAIGQRPYPLLLDPEPPRYLQSLSGPELPPPPPDRSSRLCVPAPLSTAPGAREGRSARRAARGNLEPPPRASRPARPLRPGLQQRLRRRPGAPRPRDVRSIFEQPQDPRVPAERGEGHCFAELVLPGGPGWCDLCGREVLRQALRCTNCKFTCHPECRSLIQLDCSQQEGLSRDRPSPESTLTVTFSQNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEWDAFSIPELQNFLTILEKEEQDKIQQVQKKYDKFRQKLEEALRESQGKPG

SEQ ID NO: 8105 - protein, 336 aa, Homo sapiens
MAMASPAIGQRPYPLLLDPEPPRYLQSLSGPELPPPPPDRSSRLCVPAPLSTAPGAREGRSARRAARGNLEPPPRASRPARPLRPGLQQRLRRRPGAPRPRDVRSIFEQPQDPRVPAERGEGHCFAELVLPGGPGWCDLCGREVLRQALRCTNCKFTCHPECRSLIQLDCSQQEGLSRDRPSPESTLTVTFSQNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVGCLLHP

SEQ ID NO: 8106 - protein, 393 aa, Homo sapiens
MAMASPAIGQRPYPLLLDPEPPRYLQSLSGPELPPPPPDRSSRLCVPAPLSTAPGAREGRSARRAARGNLEPPPRASRPARPLRPGLQQRLRRRPGAPRPRDVRSIFEQPQDPRVPAERGEGHCFAELVLPGGPGWCDLCGREVLRQALRCTNCKFTCHPECRSLIQLDCSQQEGLSRDRPSPESTLTVTFSQNVCKPVEETQRPPTLQEIKQKIDSYNTREKNCLGMKLSEDGTYTGFIKVHLKLRRPVTVPAGIRPQSIYDAIKEVNLAATTDKRTSFYLPLDAIKQLHISSTTTVSEVIQGLLKKFMVVDNPQKFALFKRIHKDGQVLFQKLSIADRPLYLRLLAGPDTEVLSFVLKENETGEVEWDAFSIPELQNFFLSSWCIQIYLYY

SEQ ID NO: 8107 - protein, 184 aa, Homo sapiens
MPQSKSRKIAILGYRSVGKSSLTIQFVEGQFVDSYDPTIENTFTKLITVNGQEYHLQLVDTAGQDEYSIFPQTYSIDINGYILVYSVTSIKSFEVIKVIHGKLLDMVGKVQIPIMLVGNKKDLHMERVISYEEGKALAESWNAAFLESSAKENQTAVDVFRRIILEAEKMDGAASQGKSSCSVM

SEQ ID NO: 8108 - protein, 193 aa, Homo sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRIGAFGYMECSAKTKDGVREVFEMATRAALQARRGKKKSGCLVL

SEQ ID NO: 8109 - protein, 196 aa, Homo sapiens
MAAIRKKLVVVGDGACGKTCLLIVFSKDEFPEVYVPTVFENYVADIEVDGKQVELALWDTAGQEDYDRLRPLSYPDTDVILMCFSVDSPDSLENIPEKWVPEVKHFCPNVPIILVANKKDLRSDEHVRTELARMKQEPVRTDDGRAMAVRIQAYDYLECSAKTKEGVREVFETATRAALQKRYGSQNGCINCCKVL

SEQ ID NO: 8110 - protein, 193 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 8111 - protein, 193 aa, Homo sapiens; identical to SEQ ID NO: 8110

SEQ ID NO: 8112 - protein, 193 aa, Homo sapiens; identical to SEQ ID NO: 8110

SEQ ID NO: 8113 - protein, 193 aa, Homo sapiens; identical to SEQ ID NO: 8110

SEQ ID NO: 8114 - protein, 199 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRKAGTWRTGSVPLATLSAQPRPRRECGRCLRWPLGLASRSARTSVGGAVPFSEIPKAFPTCPLPSQGYRNYPPTTPAS

SEQ ID NO: 8115 - protein, 193 aa, Homo sapiens; identical to SEQ ID NO: 8110

SEQ ID NO: 8116 - protein, 193 aa, Homo sapiens; identical to SEQ ID NO: 8110

SEQ ID NO: 8117 - protein, 193 aa, Homo sapiens; identical to SEQ ID NO: 8110

SEQ ID NO: 8118 - protein, 92 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSL

SEQ ID NO: 8119 - protein, 189 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRG

SEQ ID NO: 8120 - protein, 127 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHT

SEQ ID NO: 8121 - protein, 229 aa, Homo sapiens
MVSISGGDLPTGLDFISAPEPALSSCSLGTSAGWSPTMAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPI

SEQ ID NO: 8122 - protein, 169 aa, Homo sapiens
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVRE

SEQ ID NO: 8123 - protein, 1047 aa, Homo sapiens
MMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 8124 - protein, 870 aa, Homo sapiens
MKGWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 8125 - protein, 881 aa, Homo sapiens
MCLVKSWFLSIRSRWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 8126 - protein, 880 aa, Homo sapiens
MRTGYSSVPSKLRWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSPSKLEKNEDVNTNLTHLLNILSELVEKIFMASEILPPTLRYIYGCLQKSVQHKWPTNTTMRTRVVSGFVFLRLICPAILNPRMFNIISDSPSPIAARTLILVAKSVQNLANLVEFGAKEPYMEGVNPFIKSNKHRMIMFLDELGNVPELPDTTEHSRTDLSRDLAALHEICVAHSDELRTLSNERGAQQHVLKKLLAITELLQQKQNQYTKTNDVR

SEQ ID NO: 8127 - protein, 871 aa, Homo sapiens
RGDASGWGCSEPGPGGPWGSRAGRVGQSRAGFNMMAAEAGSEEGGPVTAGAGGGGAAAGSSAYPAVCRVKIPAALPVAAAPYPGLVETGVAGTLGGGAALGSEFLGAGSVAGALGGAGLTGGGTAAGVAGAAAGVAGAAVAGPSGDMALTKLPTSLLAETLGPGGGFPPLPPPPYLPPLGAGLGTVDEGDSLDGPEYEEEEVAIPLTAPPTNQWYHGKLDRTIAEERLRQAGKSGSYLIRESDRRPGSFVLSFLSQMNVVNHFRIIAMCGDYYIGGRRFSSLSDLIGYYSHVSCLLKGEKLLYPVAPPEPVEDRRRVRAILPYTKVPDTDEISFLKGDMFIVHNELEDGWMWVTNLRTDEQGLIVEDLVEEVGREEDPHEGKIWFHGKISKQEAYNLLMTVGQVCSFLVRPSDNTPGDYSLYFRTNENIQRFKICPTPNNQFMMGGRYYNSIGDIIDHYRKEQIVEGYYLKEPVPMQDQEQVLNDTVDGKEIYNTIRRKTKDAFYKNIVKKGYLLKKGKGKRWKNLYFILEGSDAQLIYFESEKRATKPKGLIDLSVCSVYVVHDSLFGRPNCFQIVVQHFSEEHYIFYFAGETPEQAEDWMKGLQAFCNLRKSSPGTSNKRLRQVSSLVLHIEEAHKLPVKHFTNPYCNIYLNSVQVAKTHAREGQNPVWSEEFVFDDLPPDINRFEITLSNKTKKSKDPDILFMRCQLSRLQKGHATDEWFLLSSHIPLKGIEPGSLRVRARYSMEKIMPEEEYSEFKELILQKELHVVYALSHVCGQDRTLLASILLRIFLHEKLESLLLCTLNDREISMEDEATTLFRATTLASTLMEQYMKATATQFVHHALKDSILKIMESKQSCELSSSKLQKA

SEQ ID NO: 8128 - protein, 203 aa, Homo sapiens
MGGSLRVAVLGAPGVGKTAIIRQFLFGDYPERHRPTDGPRLYRPAVLLDGAVYDLSIRDGDVAGPGSSPGGPEEWPDAKDWSLQDTDAFVLVYDICSPDSFDYVKALRQRIAETRPAGAPEAPILVVGNKRDRQRLRFGPRRALAALVRRGWRCGYLECSAKYNWHVLRLFRELLRCALVRARPAHPALRLQGALHPARCSLM

SEQ ID NO: 8129 - protein, 115 aa, Homo sapiens
MGGSLRVAVLGAPGVGKTAIIRQFLFGDYPERHRPTDGPRLYRPAVLLDGAVYDLSIRDGDVAGPGSSPGGPEEWPDAKDWSLQDTDAFVLVYDICSPDSFDYVKALRQRIAETR

SEQ ID NO: 8130 - protein, 192 aa, Homo sapiens
MQAIKCVVVGDGAVGKTCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 8131 - protein, 211 aa, Homo sapiens
MQAIKCVVVGDGAVGKTCLLISYTTNAFPGEYIPTVFDNYSANVMVDGKPVNLGLWDTAGQEDYDRLRPLSYPQTVGETYGKDITSRGKDKPIADVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 8132 - protein, 192 aa, Homo sapiens
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 8133 - protein, 86 aa, Homo sapiens
MQAIKCVVVGDGAVGKTCLLISYTTNAFPGEYIPTVPGRPCALLQDAEAGLSSDVEGACWCQTQEGRMTGEAPAPPWPALRGPHHS

SEQ ID NO: 8134 - protein, 185 aa, Homo sapiens
MQAIKAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 8135 - protein, 148 aa, Homo sapiens
MVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLKTVFDEAIRAVLCPQPTRQQKRACSLL

SEQ ID NO: 8136 - protein, 166 aa, Homo sapiens
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDTIEKLKEKKLAPITYPQGLALAKEIDSVKYLECSALTQRGLK

SEQ ID NO: 8137 - protein, 1594 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAEMKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPGEGASGASRRPWVLGKVMEKEYCQAKKAQNRFKVPLGTKFYRVKAVSWNKKV

SEQ ID NO: 8138 - protein, 1591 aa, Homo sapiens
MKLYVFLVNTGTTLTFDTELTVQTVADLKHAIQSKYKIAIQHQVLVVNGGECMAADRRVCTYSAGTDTNPIFLFNKEMILCDRPPAIPKTTFSTENDMEIKVEESLMMPAVFHTVASRTQLALEMYEVAKKLCSFCEGLVHDEHLQHQGWAAIMANLEDCSNSYQKLLFKFESIYSNYLQSIEDIKLKLTHLGTAVSVMAKIPLLECLTRHSYRECLGRLDSLPEHEDSEKAEMKRSTELVLSPDMPRTTNESLLTSFPKSVEHVSPDTADAESGKEIRESCQSTVHQQDETTIDTKDGDLPFFNVSLLDWINVQDRPNDVESLVRKCFDSMSRLDPRIIRPFIAECRQTIAKLDNQNMKAIKGLEDRLYALDQMIASCGRLVNEQKELAQGFLANQKRAENLKDASVLPDLCLSHANQLMIMLQNHRKLLDIKQKCTTAKQELANNLHVRLKWCCFVMLHADQDGEKLQALLRLVIELLERVKIVEALSTVPQMYCLAVVEVVRRKMFIKHYREWAGALVKDGKRLYEAEKSKRESFGKLFRKSFLRNRLFRGLDSWPPSFCTQKPRKFDCELPDISLKDLQFLQSFCPSEVQPFLRVPLLCDFEPLHQHVLALHNLVKAAQSLDEMSQTITDLLSEQKASVSQTSPQSASSPRMESTAGITTTTSPRTPPPLTVQDPLCPAVCPLEELSPDSIDAHTFDFETIPHPNIEQTIHQVSLDLDSLAESPESDFMSAVNEFVIEENLSSPNPISDPQSPEMMVESLYSSVINAIDSRRMQDTNVCGKEDFGDHTSLNVQLERCRVVAQDSHFSIQTIKEDLCHFRTFVQKEQCDFSNSLKCTAVEIRNIIEKVKCSLEITLKEKHQKELLSLKNEYEGKLDGLIKETEENENKIKKLKGELVCLEEVLQNKDNEFALVKHEKEAVICLQNEKDQKLLEMENIMHSQNCEIKELKQSREIVLEDLKKLHVENDEKLQLLRAELQSLEQSHLKELEDTLQVRHIQEFEKVMTDHRVSLEELKKENQQIINQIQESHAEIIQEKEKQLQELKLKVSDLSDTRCKLEVELALKEAETDEIKILLEESRAQQKETLKSLLEQETENLRTEISKLNQKIQDNNENYQVGLAELRTLMTIEKDQCISELISRHEEESNILKAELNKVTSLHNQAFEIEKNLKEQIIELQSKLDSELSALERQKDEKITQQEEKYEAIIQNLEKDRQKLVSSQEQDREQLIQKLNCEKDEAIQTALKEFKLEREVVEKELLEKVKHLENQIAKSPAIDSTRGDSSSLVAELQEKLQEEKAKFLEQLEEQEKRKNEEMQNVRTSLIAEQQTNFNTVLTREKMRKENIINDLSDKLKSTMQQQERDKDLIESLSEDRARLLEEKKKLEEEVSKLRSSSFVPSPYVATAPELYGACAPELPGESDRSAVETADEGRVDSAMETSMMSVQENIHMLSEEKQRIMLLERTLQLKEEENKRLNQRLMSQSMSSVSSRHSEKIAIRDFQVGDLVLIILDERHDNYVLFTVSPTLYFLHSESLPALDLKPASGASRRPWVLGKVMEKEYCQAKKAQNRFKVPLGTKFYRVKAVSWNKKV

SEQ ID NO: 8139 - protein, 72 aa, Homo sapiens
MVPGVAGSAAAAGEGGGVAGVADLKHAIQSKYKIAIQHQVLVVNGGECMAADRRVCTYSAGTDTNPIFLFNK

SEQ ID NO: 8140 - protein, 15 aa, Homo sapiens
MKLYVFLVNTGTTLT

SEQ ID NO: 8141 - protein, 53 aa, Homo sapiens
MAADRRVCTYSAGTDTNPIFLFNKEMILCDRPPAIPKTTFSTENDMEIKVEES

SEQ ID NO: 8142 - protein, 127 aa, Homo sapiens
  MOD_RES (1)..(1): Any amino acid
XIMLLERTLQLKEEENKRLNQRLMSQSMSSVSSRHSEKIAIRDFQVGDLVLIILDERHDNYVLFTVSPTLYFLHSESLPALDLKPASGASRRPWVLGKVMEKEYCQAKKCSFITPKTAGHLFMQKSA

SEQ ID NO: 8143 - protein, 1591 aa, Homo sapiens; identical to SEQ ID NO: 8138

SEQ ID NO: 8144 - protein, 540 aa, Homo sapiens
MNGEAICSALPTIPYHKLADLRYLSRGASGTVSSARHADWRVQVAVKHLHIHTPLLDSERKDVLREAEILHKARFSYILPILGICNEPEFLGIVTEYMPNGSLNELLHRKTEYPDVAWPLRFRILHEIALGVNYLHNMTPPLLHHDLKTQNILLDNEFHVKIADFGLSKWRMMSLSQSRSSKSAPEGGTIIYMPPENYEPGQKSRASIKHDIYSYAVITWEVLSRKQPFEDVTNPLQIMYSVSQGHRPVINEESLPYDIPHRARMISLIESGWAQNPDERPSFLKCLIELEPVLRTFEEITFLEAVIQLKKTKLQSVSSAIHLCDKKKMELSLNIPVNHGPQEESCGSSQLHENSGSPETSRSLPAPQDNDFLSRKAQDCYFMKLHHCPGNHSWDSTISGSQRAAFCDHKTTPCSSAIINPLSTAGNSERLQPGIAQQWIQSKREDIVNQMTEACLNQSLDALLSRDLIMKEDYELVSTKPTRTSKVRQLLDTTDIQGEEFAKVIVQKLKDNKQMGLQPYPEILVVSRSPSLNLLQNKSM

SEQ ID NO: 8145 - protein, 403 aa, Homo sapiens
MTPPLLHHDLKTQNILLDNEFHVKIADFGLSKWRMMSLSQSRSSKSAPEGGTIIYMPPENYEPGQKSRASIKHDIYSYAVITWEVLSRKQPFEDVTNPLQIMYSVSQGHRPVINEESLPYDIPHRARMISLIESGWAQNPDERPSFLKCLIELEPVLRTFEEITFLEAVIQLKKTKLQSVSSAIHLCDKKKMELSLNIPVNHGPQEESCGSSQLHENSGSPETSRSLPAPQDNDFLSRKAQDCYFMKLHHCPGNHSWDSTISGSQRAAFCDHKTTPCSSAIINPLSTAGNSERLQPGIAQQWIQSKREDIVNQMTEACLNQSLDALLSRDLIMKEDYELVSTKPTRTSKVRQLLDTTDIQGEEFAKVIVQKLKDNKQMGLQPYPEILVVSRSPSLNLLQNKSM

SEQ ID NO: 8146 - protein, 3458 aa, Homo sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLTRKQNYMMNFSRQHGLRHFYNRRRRSLRRYP

SEQ ID NO: 8147 - protein, 3460 aa, Homo sapiens [sequence omitted]

SEQ ID NO: 8148 - protein, 977 aa, Homo sapiens
MCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVTTRKQNYMMNFSRQHGLRHFYNRRRRSLRRYP

SEQ ID NO: 8149 - protein, 3460 aa, Homo sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVLVSTRKQNYMMNFSRQHGLRHFYNRRRRSLRRYP

SEQ ID NO: 8150 - protein, 3427 aa, Homo sapiens
MERSGWARQTFLLALLLGATLRARAAAGYYPRFSPFFFLCTHHGELEGDGEQGEVLISLHIAGNPTYYVPGQEYHVTISTSTFFDGLLVTGLYTSTSVQASQSIGGSSAFGFGIMSDHQFGNQFMCSVVASHVSHLPTTNLSFIWIAPPAGTGCVNFMATATHRGQVIFKDALAQQLCEQGAPTDVTVHPHLAEIHSDSIILRDDFDSYHQLQLNPNIWVECNNCETGEQCGAIMHGNAVTFCEPYGPRELITTGLNTTTASVLQFSIGSGSCRFSYSDPSIIVLYAKNNSADWIQLEKIRAPSNVSTIIHILYLPEDAKGENVQFQWKQENLRVGEVYEACWALDNILIINSAHRQVVLEDSLDPVDTGNWLFFPGATVKHSCQSDGNSIYFHGNEGSEFNFATTRDVDLSTEDIQEQWSEEFESQPTGWDVLGAVIGTECGTIESGLSMVFLKDGERKLCTPSMDTTGYGNLRFYFVMGGICDPGNSHENDIILYAKIEGRKEHITLDTLSYSSYKVPSLVSVVINPELQTPATKFCLRQKNHQGHNRNVWAVDFFHVLPVLPSTMSHMIQFSINLGCGTHQPGNSVSLEFSTNHGRSWSLLHTECLPEICAGPHLPHSTVYSSENYSGWNRITIPLPNAALTRNTRIRWRQTGPILGNMWAIDNVYIGPSCLKFCSGRGQCTRHGCKCDPGFSGPACEMASQTFPMFISESFGSSRLSSYHNFYSIRGAEVSFGCGVLASGKALVFNKDGRRQLITSFLDSSQSRFLQFTLRLGSKSVLSTCRAPDQPGEGVLLHYSYDNGITWKLLEHYSYLSYHEPRIISVELPGDAKQFGIQFRWWQPYHSSQREDVWAIDEIIMTSVLFNSISLDFTNLVEVTQSLGFYLGNVQPYCGHDWTLCFTGDSKLASSMRYVETQSMQIGASYMIQFSLVMGCGQKYTPHMDNQVKLEYSTNHGLTWHLVQEECLPSMPSCQEFTSASIYHASEFTQWRRVIVLLPQKTWSSATRFRWSQSYYTAQDEWALDSIYIGQQCPNMCSGHGSCDHGICRCDQGYQGTECHPEAALPSTIMSDFENQNGWESDWQEVIGGEIVKPEQGCGVISSGSSLYFSKAGKRQLVSWDLDTSWVDFVQFYIQIGGESASCNKPDSREEGVLLQYSNNGGIQWHLLAEMYFSDFSKPRFVYLELPAAAKTPCTRFRWWQPVFSGEDYDQWAVDDIIILSEKQKQIIPVINPTLPQNFYEKPAFDYPMNQMSVWLMLANEGMVKNETFCAATPSAMIFGKSDGDRFAVTRDLTLKPGYVLQFKLNIGCANQFSSTAPVLLQYSHDAGMSWFLVKEGCYPASAGKGCEGNSRELSEPTMYHTGDFEEWTRITIVIPRSLASSKTRFRWIQESSSQKNVPPFGLDGVYISEPCPSYCSGHGDCISGVCFCDLGYTAAQGTCVSNVPNHNEMFDRFEGKLSPLWYKITGAQVGTGCGTLNDGKSLYFNGPGKREARTVPLDTRNIRLVQFYIQIGSKTSGITCIKPRTRNEGLIVQYSNDNGILWHLLRELDFMSFLEPQIISIDLPQDAKTPATAFRWWQPQHGKHSAQWALDDVLIGMNDSSQTGFQDKFDGSIDLQANWYRIQGGQVDIDCLSMDTALIFTENIGKPRYAETWDFHVSASTFLQFEMSMGCSKPFSNSHSVQLQYSLNNGKDWHLVTEECVPPTIGCLHYTESSIYTSERFQNWKRITVYLPLSTISPRTRFRWIQANYTVGADSWAIDNVVLASGCPWMCSGRGICDAGRCVCDRGFGGPYCVPVVPLPSILKDDFNGNLHPDLWPEVYGAERGNLNGETIKSGTSLIFKGEGLRMLISRDLDCTNTMYVQFSLRFIAKSTPERSHSILLQFSISGGITWHLMDEFYFPQTTNILFINVPLPYTAQTNATRFRLWQPYNNGKKEEIWIVDDFIIDGNNVNNPVMLLDTFDFGPREDNWFFYPGGNIGLYCPYSSKGAPEEDSAMVFVSNEVGEHSITTRDLNVNENTIIQFEINVGCSTDSSSADPVRLEFSRDFGATWHLLLPLCYHSSSHVSSLCSTEHHPSSTYYAGTMQGWRREVVHFGKLHLCGSVRFRWYQGFYPAGSQPVTWAIDNVYIGPQCEEMCNGQGSCINGTKCICDPGYSGPTCKISTKNPDFLKDDFEGQLESDRFLLMSGGKPSRKCGILSSGNNLFFNEDGLRMLMTRDLDLSHARFVQFFMRLGCGKGVPDPRSQPVLLQYSLNGGLSWSLLQEFLFSNSSNVGRYIALEIPLKARSGSTRLRWWQPSENGHFYSPWVIDQILIGGNISGNTVLEDDFTTLDSRKWLLHPGGTKMPVCGSTGDALVFIEKASTRYVVSTDVAVNEDSFLQIDFAASCSVTDSCYAIELEYSVDLGLSWHPLVRDCLPTNVECSRYHLQRILVSDTFNKWTRITLPLPPYTRSQATRFRWHQPAPFDKQQTWAIDNVYIGDGCIDMCSGHGRCIQGNCVCDEQWGGLYCDDPETSLPTQLKDNFNRAPSSQNWLTVNGGKLSTVCGAVASGMALHFSGGCSRLLVTVDLNLTNAEFIQFYFMYGCLITPNNRNQGVLLEYSVNGGITWNLLMEIFYDQYSKPGFVNILLPPDAKEIATRFRWWQPRHDGLDQNDWAIDNVLISGSADQRTVMLDTFSSAPVPQHERSPADAGPVGRIAFDMFMEDKTSVNEHWLFHDDCTVERFCDSPDGVMLCGSHDGREVYAVTHDLTPTEGWIMQFKISVGCKVSEKIAQNQIHVQYSTDFGVSWNYLVPQCLPADPKCSGSVSQPSVFFPTKGWKRITYPLPESLVGNPVRFRFYQKYSDMQWAIDNFYLGPGCLDNCRGHGDCLREQCICDPGYSGPNCYLTHTLKTFLKERFDSEEIKPDLWMSLEGGSTCTECGILAEDTALYFGGSTVRQAVTQDLDLRGAKFLQYWGRIGSENNMTSCHRPICRKEGVLLDYSTDGGITWTLLHEMDYQKYISVRHDYILLPEDALTNTTRLRWWQPFVISNGIVVSGVERAQWALDNILIGGAEINPSQLVDTFDDEGTSHEENWSFYPNAVRTAGFCGNPSFHLYWPNKKKDKTHNALSSRELIIQPGYMMQFKIVVGCEATSCGDLHSVMLEYTKDARSDSWQLVQTQCLPSSSNSIGCSPFQFHEATIYNSVNSSSWKRITIQLPDHVSSSATQFRWIQKGEETEKQSWAIDHVYIGEACPKLCSGHGYCTTGAICICDESFQGDDCSVFSHDLPSYIKDNFESARVTEANWETIQGGVIGSGCGQLAPYAHGDSLYFNGCQIRQAATKPLDLTRASKIMFVLQIGSMSQTDSCNSDLSGPHAVDKAVLLQYSVNNGITWHVIAQHQPKDFTQAQRVSYNVPLEARMKGVLLRWWQPRHNGTGHDQWALDHVEVVL

SEQ ID NO: 8151 - protein, 555 aa, Homo sapiens
MKKHDFAENLPSSLLIIILVIFTLSGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATSFLSLFPKLRATEQMTNVGC

SEQ ID NO: 8152 - protein, 1376 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGTSRF

SEQ ID NO: 8153 - protein, 799 aa, Homo sapiens
MNLGKELSNETHVSNDQQSATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGSGTHGSRDLPVNRIIDVDLVTGSAPGRDGGIAGAQAGPGRSQASGGPPTSDLPGLGPVPGEPAKPKTSAHHATFV

SEQ ID NO: 8154 - protein, 1447 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLESATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATGEERTLGKSNSIKIKGENGKNARDPRLSKREESIAKIGKKKYQKINLDEAEEFFELISKAQSNRADDQRGLLRKEDLVLPEFLRLPPGSTELTLPTPAAVAKGFSKRSATGNGRESASQPGEQWEPVQESSDSPSTSPGSASSPPGPPGTTPPGQKSPSGPFCTPQSPVSLAQEGTAQIWKRQSQEVEAGGIQTVEDEHVAELTLMGEGDISSPNSTLLPPPSTPQEVPGPSRPGSGTHGSRDLPVNRIIDVDLVTGSAPGRDGGIAGAQAGPGRSQASGGPPTSDLPGLGPVPGEPAKPKTSAHHATFV

SEQ ID NO: 8155 - protein, 1376 aa, Homo sapiens; identical to SEQ ID NO: 8152

SEQ ID NO: 8156 - protein, 499 aa, Homo sapiens
MSLSLFFQSATVSDGELTGADLKDCVSNNSLSSNASLPSVQSCRRLRERRVASWAVSFERLLQDPVGVRYFSDFLRKEFSEENILFWQACEYFNHVPAHDKKELSYRAREIFSKFLCSKATTPVNIDSQAQLADDVLRAPHPDMFKEQQLQIFNLMKFDSYTRFLKSPLYQECILAEVEGRALPDSQQVPSSPASKHSLGSDHSSVSTPKKLSGKSKSGRSLNEELGDEDSEKKRKGAFFSWSRTRSTGRSQKKREHGDHADDALHANGGLCRRESQGSVSSAGSLDLSEACRTLAPEKDKATKHCCIHLPDGTSCVVAVKAGFSIKDILSGLCERHGINGAAADLFLVGGDKPLVLHQDSSILESRDLRLEKRTLFRLDLVPINRSVGLKAKPTKPVTEVLRPVVARYGLDLSGLLVRLSGEKEPLDLGAPISSLDGQRVVLEEKDPSRGKASADKQKGVPVKQNTAVNSSSRNHSATSFLSLFPKLRATEQMTNVGC

SEQ ID NO: 8157 - protein, 667 aa, Homo sapiens
MFRAGEASKRPLPGPSPPRVRSVEVARGRAGYGFTLSGQAPCVLSCVMRGSPADFVGLRAGDQILAVNEINVKKASHEDVVKLIGKCSGVLHMVIAEGVGRFESCSSDEEGGLYEGKGWLKPKLDSKALGINRAERVVEEMQSGGIFNMIFENPSLCASNSEPLKLKQRSLSESAATRFDVGHESINNPNPNMLSKEEISKVIHDDSVFSIGLESHDDFALDASILNVAMIVGYLGSIELPSTSSNLESDSLQAIRGCMRRLRAEQKIHSLVTMKIMHDCVQLSTDKAGVVAEYPAEKLAFSAVCPDDRRFFGLVTMQTNDDGSLAQEEEGALRTSCHVFMVDPDLFNHKIHQGIARRFGFECTADPDTNGCLEFPASSLPVLQFISVLYRDMGELIEGMRARAFLDGDADAHQNNSTSSNSDSGIGNFHQEEKSNRVLVVDLGGSSSRHGPGGSAWDGVGGRGAQPWGAPWTGPFCPDPEGSPPFEAAHQTDRFWDLNKHLGPASPVEVPPASLRSSVPPSKRGTVGAGCGFNQRWLPVHVLREWQCGHTSDQDSYTDSTDGWSSINCGTLPPPMSKIPADRYRVEGSFAQPPLNAPKREWSRKAFGMQSIFGPHRNVRKTKEDKKGSKFGRGTGLTQPSQRTSARRSFGRSKRFSITRSLDDLES

SEQ ID NO: 8158 - protein, 211 aa, Homo sapiens
MQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 8159 - protein, 1400 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPHKDHEGAGGARPVAAVPGVGAACPAAGAGCTRSGRNTHLPLAGRRDRGAAGVRPVPPRHLCAAAVPPRQPHDVWPVSTAPLHAVLELPRALPLLQRPLRGA

SEQ ID NO: 8160 - protein, 545 aa, Homo sapiens
MPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 8161 - protein, 1219 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 8162 - protein, 1243 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRSRCRATLWVLETAPPRPTVLSPTRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHSNSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 8163 - protein, 1147 aa, Homo sapiens
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 8164 - protein, 1148 aa, Homo sapiens
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 8165 - protein, 187 aa, Homo sapiens
PEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEELGYSYVELNASDTRSKSSLKAIVAESLNNTSIKGFYSNGAASSVSTKHALIMDEVDGM

SEQ ID NO: 8166 - protein, 616 aa, Homo sapiens
MVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVYYFSKGTLKIANKQFTAVKNDYEMTFNNETSVMPCEDDHHLPTVQFDFTGIDDLENKSKDSLVDIIGICKSYEDATKITVRSNNREVAKRNIYLMDTSGKVVTATLWGEDADKFDGSRQPVLAIKGARVSDFGGRSLSVLSSSTIIANPDIPEAYKLRGWFDAEGQALDGVSISDLKSGGVGGSNTNWKTLYEVKSENLGQGDKPDYFSSVATVVYLRKENCMYQACPTQDCNKKVIDQQNGLYRCEKCDTEFPNFKYRMILSVNIADFQENQWVTCFQESAEAILGQNAAYLGELKDKNEQAFEEVFQNANFRSFIFRVRVKVETYNDESRIKATVMDVKPVDYREYGRRLVMSIRRSALM

SEQ ID NO: 8167 - protein, 121 aa, Homo sapiens
MVDMMDLPRSRINAGMLAQFIDKPVCFVGRLEKIHPTGKMFILSDGEGKNGTIELMEPLDEEISGIVEVVGRVTAKATILCTSYVQFKEDSHPFDLGLYNEAVKIIHDFPQFYPLGIVQHD

SEQ ID NO: 8168 - protein, 121 aa, Homo sapiens; identical to SEQ ID NO: 8167

SEQ ID NO: 8169 - protein, 928 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 8170 - protein, 53 aa, Homo sapiens
MPPKTPRKTAATAAAAAAEPPAPPPPPPPEEDPEQDSGPEDLPLVRGSITNGR

SEQ ID NO: 8171 - protein, 907 aa, Homo sapiens
MPPKTPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 8172 - protein, 897 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 8173 - protein, 902 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSMLFYIDEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 8174 - protein, 865 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDESIMQICQQKKEKRNWLPAQDTDSATFHPTHQRIFGKLVFLPLRLVWKEVILRKILILVLVQKDVSLTTQYFLQKARSRRH

SEQ ID NO: 8175 - protein, 897 aa, Homo sapiens; identical to SEQ ID NO: 8172

SEQ ID NO: 8176 - protein, 867 aa, Homo sapiens
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDESIMQICQQKKEKRNWLPAQDTDSATFHPTHQRIFGKLVFLPLRLVWKEVILRKILILVLVQKDVSLTTQYFLQKARSRRHRR

SEQ ID NO: 8177 - protein, 1014 aa, Homo sapiens
MFEDKPHAEGAAVVAAAGEALQALCQELNLDEGSAAEALDDFTAIRGNYSLEGEVTHWLACSLYVACRKSIIPTVGKGIMEGNCVSLTRILRSAKLSLIQFFSKMKKWMDMSNLPQEFRERIERLERNFEVSTVIFKKYEPIFLDIFQNPYEEPPKLPRSRKQRRIPCSVKDLFNFCWTLFVYTKGNFRMIGDDLVNSYHLLLCCLDLIFANAIMCPNRQDLLNPSFKGLPSDFHTADFTASEEPPCIIAVLCELHDGLLVEAKGIKEHYFKPYISKLFDRKILKGECLLDLSSFTDNSKAVNKEYEEYVLTVGDFDERIFLGADAEEEIGTPRKFTRDTPLGKLTAQANVEYNLQQHFEKKRSFAPSTPLTGRRYLREKEAVITPVASATQSVSRLQSIVAGLKNAPSDQLINIFESCVRNPVENIMKILKGIGETFCQHYTQSTDEQPGSHIDFAVNRLKLAEILYYKILETVMVQETRRLHGMDMSVLLEQDIFHRSLMACCLEIVLFAYSSPRTFPWIIEVLNLQPFYFYKVIEVVIRSEEGLSRDMVKHLNSIEEQILESLAWSHDSALWEALQVSANKVPTCEEVIFPNNFETGNGGNVQGHLPLMPMSPLMHPRVKEVRTDSGSLRRDMQPLSPISVHERYSSPTAGSAKRRLFGEDPPKEMLMDKIITEGTKLKIAPSSSITAENVSILPGQTLLTMATAPVTGTTGHKVTIPLHGVANDAGEITLIPLSMNTNQESKVKSPVSLTAHSLIGASPKQTNLTKAQEVHSTGINRPKRTGSLALFYRKVYHLASVRLRDLCLKLDVSNELRRKIWTCFEFTLVHCPDLMKDRHLDQLLLCAFYIMAKVTKEERTFQEIMKSYRNQPQANSHVYRSVLLKSIPREVVAYNKNINDDFEMIDCDLEDATKTPDCSSGPVKEERGDLIKFYNTIYVGRVKSFALKYDLANQDHMMDAPPLSPFPHIKQQPGSPRRISQQHSIYISPHKNGSGLTPRSALLYKFNGSPSKVR

SEQ ID NO: 8178 - protein, 1068 aa, Homo sapiens
MFEDKPHAEGAAVVAAAGEALQALCQELNLDEGSAAEALDDFTAIRGNYSLEGEVTHWLACSLYVACRKSIIPTVGKGIMEGNCVSLTRILRSAKLSLIQFFSKMKKWMDMSNLPQEFRERIERLERNFEVSTVIFKKYEPIFLDIFQNPYEEPPKLPRSRKQRRIPCSVKDLFNFCWTLFVYTKGNFRMIGDDLVNSYHLLLCCLDLIFANAIMCPNRQDLLNPSFKGLPSDFHTADFTASEEPPCIIAVLCELHDGLLVEAKGIKEHYFKPYISKLFDRKILKGECLLDLSSFTDNSKAVNKEYEEYVLTVGDFDERIFLGADAEEEIGTPRKFTRDTPLGKLTAQANVEYNLQQHFEKKRSFAPSTPLTGRRYLREKEAVITPVASATQSVSRLQSIVAGLKNAPSDQLINIFESCVRNPVENIMKILKGIGETFCQHYTQSTDEQPGSHIDFAVNRLKLAEILYYKILETVMVQETRRLHGMDMSVLLEQDIFHRSLMACCLEIVLFAYSSPRTFPWIIEVLNLQPFYFYKVIEVVIRSEEGLSRDMVKHLNSIEEQILESLAWSHDSALWEALQVSANKVPTCEEVIFPNNFETGNGGNVQGHLPLMPMSPLMHPRVKEVRTDSGSLRRDMQPLSPISVHERYSSPTAGSAKRRLFGEDPPKEMLMDKIITEGTKLKIAPSSSITAENVSILPGQTLLTMATAPVTGTTGHKVTIPLHGVANDAGEITLIPLSMNTNQESKVKSPVSLTAHSLIGASPKQTNLTKAQEVHSTGINRPKRTGSLALFYRKVYHLASVRLRDLCLKLDVSNELRRKIWTCFEFTLVHCPDLMKDRHLDQLLLCAFYIMAKVTKEERTFQEIMKSYRNQPQANSHVYRSVLLKSIPREVVAYNKNINDDFEMIDCDLEDATKTPDCSSGPVKEERGDLIKFYNTIYVGRVKSFALKYDLANQDHMMDAPPLSPFPHIKQQPGSPRRISQQHSIYISPHKNGSGLTPRSALLYKFNGSPSKSLKDINNMIRQGEQRTKKRVIAIDSDAESPAKRVCQENDDVLLKRLQDVVSERANH

SEQ ID NO: 8179 - protein, 1139 aa, Homo sapiens
MPSGGDQSPPPPPPPPAAAASDEEEEDDGEAEDAAPPAESPTPQIQQRFDELCSRLNMDEAARAEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 8180 - protein, 849 aa, Homo sapiens
MESRCVAQAGMQWHDLGSLQPLPPRFKRFFCLSLLSSCEYSKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 8181 - protein, 555 aa, Homo sapiens
MQSLTKGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLE

SEQ ID NO: 8182 - protein, 518 aa, Homo sapiens
MISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 8183 - protein, 448 aa, Homo sapiens
MFDCMDVLSVSPGQILDFYTASPSSCMLQEKALKACFSGLTQTEWQHRHTAQSIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 8184 - protein, 455 aa, Homo sapiens
MTTSGHACPVPAVNGHMTHYPATPYPLLFPPVIGGLSLPPLHGLHGHPPPSGCSTPSPATIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 8185 - protein, 336 aa, Homo sapiens
MIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 8186 - protein, 336 aa, Homo sapiens; identical to SEQ ID NO: 8185

SEQ ID NO: 8187 - protein, 441 aa, Homo sapiens
MTTSGHACPVPAVNGHMTHYPATPYPLLFPPVIGGLSLPPLHGLHGHPPPSGCSTPSPATIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPEGHEPLTPSSSGNTAEHSPSISPSSVENSGVSQSPLVQ

SEQ ID NO: 8188 - protein, 153 aa, Homo sapiens
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMSETGFSS

SEQ ID NO: 8189 - protein, 197 aa, Homo sapiens
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMTTVSWDGDKLQCVQKGEKEGRGWTQWIEGDELHLEMRVEGVVCKQVFKKVQ

SEQ ID NO: 8190 - protein, 157 aa, Homo sapiens
MDPPAGFVRAGNPAVAAPQSPLSPEGAHFRAAHHPRSTGSRCPGSLQPSRPLVANWLQSLPEMPVDFTGYWKMLVNENFEEYLRALDVNVALRKIANLLKPDKEIVQDGDHMIIRTLSTFRNYIMDFQVGKEFEEDLTGIDDRKCMAGVQSRDLSSL

SEQ ID NO: 8191 - protein, 1251 aa, Homo sapiens
MRRGGWRKRAENDGWETWGGYMAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 8192 - protein, 1250 aa, Homo sapiens
MRRGGWRKRAENDGWETWGGYMAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 8193 - protein, 971 aa, Homo sapiens
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYENALFSCISRNEMGSVCCSYAGHHTNCREYCQAIFRTDSSPGPSQIKAVENYCASISPQLIHCVNNYTQSYPMRNPTDSLYCCDRAEDHACQNACKRILMSKKTEMEIVDGLIEGCKTQPLPQDPLWQCFLESSQSVHPGVTVHPPPSTGLDGAKLHCCSKANTSTCRELCTKLYSMSWGNTQSWQEFDRFCEYNPVEVSMLTCLADVREPCQLGCRNLTYCTNFNNRPTELFRSCNAQSDQGAMNDMKLWEKGSIKMPFINIPVLDIKKCQPEMWKAIACSLQIKPCHSKSRGSIICKSDCVEILKKCGDQNKFPEDHTAESICELLSPTDDLKNCIPLDTYLRPSTLGNIVEEVTHPCNPNPCPANELCEVNRKGCPSGDPCLPYFCVQGCKLGEASDFIVRQGTLIQVPSSAGEVGCYKICSCGQSGLLENCMEMHCIDLQKSCIVGGKRKSHGTSFSIDCNVCSCFAGNLVCSTRLCLSEHSSEDDRRTFTGLPCNCADQFVPVCGQNGRTYPSACIARCVGLQDHQFEFGSCMSKDPCNPNPCQKNQRCIPKPQVCLTTFDKFGCSQYECVPRQLACDQVQDPVCDTDHMEHNNLCTLYQRGKSLSYKGPCQPFCRATEPVCGHNGETYSSVCAAYSDRVAVDYYGDCQAVGVLSEHSSVAECASVKCPSLLAAGCKPIIPPGACCPLCAGMLRVLFDKEKLDTIAKVTNKKPITVLEILQKIRMHVSVPQCDVFGYFSIESEIVILIIPVDHYPKALQIEACNKEAEKIESLINSDSPTLASHVPLSALIISQVQVSSSVPSAGVRARPSCHSLLLPLSLGLALHLLWTYN

SEQ ID NO: 8194 - protein, 244 aa, Homo sapiens
MKERRASQKLSSKSIMDPNQNVKCKIVVVGDSQCGKTALLHVFAKDCFPENYVPTVFENYTASFEIDTQRIELSLWDTSGSPYYDNVRPLSYPDSDAVLICFDISRPETLDSVLKKWKGEIQEFCPNTKMLLVGCKSDLRTDVSTLVELSNHRQTPVSYDQGANMAKQIGAATYIECSALQSENSVRDIFHVATLACVNKTNKNVKRNKSQRATKRISHMPSRPELSAVATDLRKDKAKSCTVM

SEQ ID NO: 8195 - protein, 244 aa, Homo sapiens; identical to SEQ ID NO: 8194

SEQ ID NO: 8196 - protein, 115 aa, Homo sapiens
MLLVGCKSDLRTDVSTLVELSNHRQTPVSYDQGANMAKQIGAATYIECSALQSENSVRDIFHVATLACVNKTNKNVKRNKSQRATKRISHMPSRPELSAVATDLRKDKAKSCTVM

SEQ ID NO: 8197 - protein, 116 aa, Homo sapiens
MKERRASQKLSSKSIMDPNQNVKCKIVVVGDSQCGKTALLHVFAKDCFPENYVPTVFENYTASFEIDTQRIELSLWDTSGSPYYDNVRPLSYPDSDAVLICFDISRPETLDSVLKK

SEQ ID NO: 8198 - protein, 116 aa, Homo sapiens; identical to SEQ ID NO: 8197

SEQ ID NO: 8199 - protein, 204 aa, Homo sapiens
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKIDKTDYMVGSYGPRAEEYEFLTPVEEAPKGMLARGSYSIKSRFTDDDKTDHLSWEWNLTIKKDWKD

SEQ ID NO: 8200 - protein, 178 aa, Homo sapiens
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKIDKTDYMVGSYSIKSRFTDDDKTDHLSWEWNLTIKKDWKD

SEQ ID NO: 8201 - protein, 204 aa, Homo sapiens; identical to SEQ ID NO: 8199

SEQ ID NO: 8202 - protein, 1191 aa, Homo sapiens
MEAMSPQQETLGGQPGRSSSLTGVSRLAGGSCTKKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 8203 - protein, 1165 aa, Homo sapiens
MTFWIIINKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 8204 - protein, 1168 aa, Homo sapiens
MSARERQPALKKKMKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 8205 - protein, 1155 aa, Homo sapiens
MKTLAERRRSAPSLILDKALQKRPTTRDSPSASVDTCTFLSSLVCSNRTLLIDGRAELKRGLQRQERHLFLFNDLFVVAKIKYNNNFKIKNKIKLTDMWTASCVDEVGEGNTNAMKSFVLGWPTVNFVATFSSPEQKDKWLSLLQRYINLEKEKDYPKSIPLKIFAKDIGNCAYSKTITVMNSDTANEVINMSLPMLGITGSERDYQLWVNSGKEEAPYPLIGHEYPYGIKMSHLRDSALLTPGSKDSTTPFNLQEPFLMEQLPREMQCQFILKPSRLAAAQQLSDSGHKTFKRRRSIINWAFWRGSSTHLDNLPSSPTSPMPGQLFGISLPNICENDNLPKPVLDMLFFLNQKGPLTKGIFRQSANVKSCRELKEKLNSGVEVHLDCESIFVIASVLKDFLRNIPGSIFSSDLYDHWVSVMDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRYLTKDI

SEQ ID NO: 8206 - protein, 1155 aa, Homo sapiens; identical to SEQ ID NO: 8205

SEQ ID NO: 8207 - protein, 731 aa, Homo sapiens
MDQGNDEEKINTVQRLLDQLPRANVVLLRYLFGVLHNIEQHSSSNQMTAFNLAVCVAPSILWPPASSSPELENEFTKKVSLLIQFLIENCLRIFGEEITSLFREVSVRCDTRENASDISCFQLNDSSYDSLENELNEDVDAPCSDLVKKLGQGSRSMDSVLTLSDYDLDQPEVEGLLTLSDFDLAHSKDEDVQMKRPLESKPVNILVYTKIPLRDHARAPSAMCTPSYLSTAAANAAKSLRRHRRCSEPSIDYLDSKLSYLREFYQKKLRKSSCDAILSQKDEDYLKQNQPLQEEGKTCFKQSLVTGTDVSKKNATTQNTKKKSLSGSEGNHVKLFPKSKPVAISVASYSPMSSQDHSKNQPFDVNTSGYSPPHTADALKGPRTHRRCSEPNIEDQNRKLTYLRGIYSKKQHKTSCEAGLLHGEEDYLKRHKSLQMEGQKLINQSLVMGIEVGKSSATNQNTEKVLPPRLNLCPRTSYSSLSSPGTSPSGSSVSSQDSAFSQISEHSVFTPTETSSPIDCTFQAQRKREDLSPDFSNASHVSGMPGPSSGQACSRPAYTKKDTMEWHSQMHSVTLHPSTWLRNGVASLKNWSLKKKAKAARPEEEKIASPKGPLEPPPHASGVPEANSLQEEQKDLPLRAAEGLSPVQSAQRCSSSPFQDSERHCSSPFSLVESRLKLCMKSHEEIEPGSQSSSGSLPWERASASSWTLEDATSPDSGPTVVCDIEDRNCC

SEQ ID NO: 8208 - protein, 1165 aa, Homo sapiens; identical to SEQ ID NO: 8203

SEQ ID NO: 8209 - protein, 1513 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKALQKLQAERDALILKHIHFVYHPTKETCPSCPACVDAKIEHLISSRFIRPSDRNQKNSLSDPNIDRINLVILGKDGLARELANEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSPLHPHRPTPQPSRNIPWQTKEH

SEQ ID NO: 8210 - protein, 1499 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKALQKLQAERDALILKHIHFVYHPTKETCPSCPACVDAKIEHLISSRFIRPSDRNQKNSLSDPNIDRINLVILGKDGLARELANEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSQLQAEHTL

SEQ ID NO: 8211 - protein, 749 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKALQKLQAERDALILKHIHFVYHPTKETCPSCPACVDAKIEHLISSRFIRPSDRNQKNSLSDPNIDRINLVILGKDGLARELANEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGAADLSWLGPI

SEQ ID NO: 8212 - protein, 705 aa, Homo sapiens
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 8213 - protein, 782 aa, Homo sapiens
MNSAEQTVTWLITLGVLESPKKTISDPEGFLQASLKDGVVLCRLLERLLPGTIEKVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 8214 - protein, 731 aa, Homo sapiens
MNSAEQTVTWLITLGVLESPKKTISDPEGFLQASLKDGVVLCRLLERLLPGTIEKVYPEPRSESECLSNIREFLRGCGASLRLEDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 8215 - protein, 625 aa, Homo sapiens
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 8216 - protein, 646 aa, Homo sapiens
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 8217 - protein, 721 aa, Homo sapiens
MKTFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSSSRKESAPQVLLPEEEKIIVEETKSNGQTVIEEKSLVDTVYALKDEVQELRQDNKKMKKSLEEEQRARKDLEKLVRKVLKNMNDPAWDETNL

SEQ ID NO: 8218 - protein, 753 aa, Homo sapiens
MNSAEQTVTWLITLGVLESPKKTISDPEGFLQASLKDGVVLCRLLERLLPGTIEKTFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 8219 - protein, 803 aa, Homo sapiens
MNSAEQTVTWLITLGVLESPKKTISDPEGFLQASLKDGVVLCRLLERLLPGTIEKVYPEPRSESECLSNIREFLRGCGASLRLELLFPPSQPPQHLVTTILLSASTFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 8220 - protein, 646 aa, Homo sapiens; identical to SEQ ID NO: 8216

SEQ ID NO: 8221 - protein, 66 aa, Homo sapiens
MTDNSNNQLVVRAKFNFQQTNEDELSFSKGDVIHVTRVEEGGWWEGTLNGRTGWFPSNYVREVKAS

SEQ ID NO: 8222 - protein, 447 aa, Homo sapiens
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPH

SEQ ID NO: 8223 - protein, 61 aa, Homo sapiens
MTDNSNNQLVVRAKFNFQQTNEDELSFSKGDVIHVTRVEEGGWWEGTLNGRTGWFPSNYVR

SEQ ID NO: 8224 - protein, 39 aa, Homo sapiens
MTDNSNNQLVVRAKFNFQQTNEDELSFSKGDVIHVTRVE

SEQ ID NO: 8225 - protein, 181 aa, Homo sapiens
MCFPRSSVTTDDHQLDGIKSTRAPAPGCCCCPSETLRSGEVARSSAESRRLLFKPDATDENPVPHVLCQSPFCSECPHGTQDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGA

SEQ ID NO: 8226 - protein, 689 aa, Homo sapiens
IPPSKPLRGSSLWGCWSRPKTISDPEGFLQASLKDGVVLCRLLERLLPGTIEKVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPMRSSRPGKAQLLWKKMLRF

SEQ ID NO: 8227 - protein, 1354 aa, Homo sapiens
MSTGDSFETRFEKMDNLLRDPKSEVNSDCLLDGLDALVYDLDFPALRKNKNIDNFLSRYKDTINKIRDLRMKAEDYEVVKVIGRGAFGEVQLVRHKSTRKVYAMKLLSKFEMIKRSDSAFFWEERDIMAFANSPWVVQLFYAFQDDRYLYMVMEYMPGGDLVNLMSNYDVPEKWARFYTAEVVLALDAIHSMGFIHRDVKPDNMLLDKSGHLKLADFGTCMKMNKEGMVRCDTAVGTPDYISPEVLKSQGGDGYYGRECDWWSVGVFLYEMLVGDTPFYADSLVGTYSKIMNHKNSLTFPDDNDISKEAKNLICAFLTDREVRLGRNGVEEIKRHLFFKNDQWAWETLRDTVAPVVPDLSSDIDTSNFDDLEEDKGEEETFPIPKAFVGNQLPFVGFTYYSNRRYLSSANPNDNRTSSNADKSLQESLQKTIYKLEEQLHNEMQLKDEMEQKCRTSNIKLDKIMKELDEEGNQRRNLESTVSQIEKEKMLLQHRINEYQRKAEQENEKRRNVENEVSTLKDQLEDLKKVSQNSQLANEKLSQLQKQLEEANDLLRTESDTAVRLRKSHTEMSKSISQLESLNRELQERNRILENSKSQTDKDYYQLQAILEAERRDRGHDSEMIGDLQARITSLQEEVKHLKHNLEKVEGERKEAQDMLNHSEKEKNNLEIDLNYKLKSLQQRLEQEVNEHKVTKARLTDKHQSIEEAKSVAMCEMEKKLKEEREAREKAENRVVQIEKQCSMLDVDLKQSQQKLEHLTGNKERMEDEVKNLTLQLEQESNKRLLLQNELKTQAFEADNLKGLEKQMKQEINTLLEAKRLLEFELAQLTKQYRGNEGQMRELQDQLEAEQYFSTLYKTQVKELKEEIEEKNRENLKKIQELQNEKETLATQLDLAETKAESEQLARGLLEEQYFELTQESKKAASRNRQEITDKDHTVSRLEEANSMLTKDIEILRRENEELTEKMKKAEEEYKLEKEEEISNLKAAFEKNINTERTLKTQAVNKLAEIMNRKDFKIDRKKANTQDLRKKEKENRKLQLELNQEREKFNQMVVKHQKELNDMQAQLVEECAHRNELQMQLASKESDIEQLRAKLLDLSDSTSVASFPSADETDGNLPESRIEGWLSVPNRGNIKRYGWKKQYVVVSSKKILFYNDEQDKEQSNPSMVLDIDKLFHVRPVTQGDVYRAETEEIPKIFQILYANEGECRKDVEMEPVQQAEKTNFQNHKGHEFIPTLYHFPANCDACAKPLWHVFKPPPALECRRCHVKCHRDHLDKKEDLICPCKVSYDVTSARDMLLLACSQDEQKKWVTHLVKKIPKNPPSGFVRASPRTLSTRSTANQSFRKVVKNTSGKTS

SEQ ID NO: 8228 - protein, 156 aa, Homo sapiens
MAPARAGFCPLLLLLLLGLWVAEIPVSAKPKGMTSSQWFKIQHMQPSPQACNSAMKNINKHTKRCKDLNTFLHEPFSSVAATCQTPKIACKNGDKNCHQSHGAVSLTMCKLTSGKHPNCRYKEKRQNKSYVVACKPPQKKDSQQFHLVPVHLDRVL

SEQ ID NO: 8229 - protein, 156 aa, Homo sapiens; identical to SEQ ID NO: 8228

SEQ ID NO: 8230 - protein, 525 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 8231 - protein, 472 aa, Homo sapiens
MDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 8232 - protein, 451 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSTAMC

SEQ ID NO: 8233 - protein, 502 aa, Homo sapiens
MRRRRRRDGFYPAPDFRDREAEDMAGVFDIDLDQPEDAGSEDELEEGGQLNESMDHGGVGPYELGMEHCEKFEISETSVNRGPEKIRPECFELLRVLGKGGYGKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 8234 - protein, 643 aa, Homo sapiens
MKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 8235 - protein, 228 aa, Homo sapiens
MPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNP

SEQ ID NO: 8236 - protein, 735 aa, Homo sapiens
MPLAQLKEPWPLMELVPLDPENGQTSGEEAGLQPSKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 8237 - protein, 166 aa, Homo sapiens
AQPDDTFYFDTEFTSRTPKDSPGIPPSAGAHQLFRGFSFVATGLMEDDGKPRAPQAPLHSVVQVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNP

SEQ ID NO: 8238 - protein, 719 aa, Homo sapiens
MQTPADFPRVERDLVPCPRKDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 8239 - protein, 744 aa, Homo sapiens
MEQDPKPPRLRLWALIPWLPRKQRPRISQTSLPVPGPGSGPQRDSDEGVLKEISITHHVKAGSEKADPSHFELLKVLGQGSFGKVFLVRKVTRPDSGHLYAMKVLKKATLKVRDRVRTKMERDILADVNHPFVVKLHYAFQTEGKLYLILDFLRGGDLFTRLSKEVMFTEEDVKFYLAELALGLDHLHSLGIIYRDLKPENILLDEEGHIKLTDFGLSKEAIDHEKKAYSFCGTVEYMAPEVVNRQGHSHSADWWSYGVLMFEMLTGSLPFQGKDRKETMTLILKAKLGMPQFLSTEAQSLLRALFKRNPANRLGSGPDGAEEIKRHVFYSTIDWNKLYRREIKPPFKPAVAQPDDTFYFDTEFTSRTPKDSPGIPPSAGAHQLFRGFSFVATGLMEDDGKPRAPQAPLHSVVQQLHGKNLVFSDGYVVKETIGVGSYSECKRCVHKATNMEYAVKVIDKSKRDPSEEIEILLRYGQHPNIITLKDVYDDGKHVYLVTELMRGGELLDKILRQKFFSEREASFVLHTIGKTVEYLHSQGVVHRDLKPSNILYVDESGNPECLRICDFGFAKQLRAENGLLMTPCYTANFVAPEVLKRQGYDEGCDIWSLGILLYTMLAGYTPFANGPSDTPEEILTRIGSGKFTLSGGNWNTVSETAKDLVSKMLHVDPHQRLTAKQVLQHPWVTQKDKLPQSQLSHQDLQLVKGAMAATYSALNSSKPTPQLKPIESSILAQRRVRKLPSTTL

SEQ ID NO: 8240 - protein, 733 aa, Homo sapiens
MDLSMKKFAVRRFFSVYLRRKSRSKSSSLSRLEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 8241 - protein, 166 aa, Homo sapiens
MFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGEKTALCPRVSCSRLLGF

SEQ ID NO: 8242 - protein, 644 aa, Homo sapiens
MKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 8243 - protein, 644 aa, Homo sapiens; identical to SEQ ID NO: 8242

SEQ ID NO: 8244 - protein, 741 aa, Homo sapiens
MPIAQLLELWKKIEVEPMEIETTEEDLNLDVEPTTEDTAEEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 8245 - protein, 171 aa, Homo sapiens
MPIAQLLELWKKIEVEPMEIETTEEDLNLDVEPTTEDTAEEGKSDSAACKTKVAGSVEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDL

SEQ ID NO: 8246 - protein, 758 aa, Homo sapiens
MPIAQLLELWKKIEVEPMEIETTEEDLNLDVEPTTEDTAEEGKSDSAACKTKVAGSVEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTGSLPFQGKDRKETMALILKAKLGMPQFLSGEAQSLLRALFKRNPCNRLGAGIDGVEEIKRHPFFVTIDWNTLYRKEIKPPFKPAVGRPEDTFHFDPEFTARTPTDSPGVPPSANAHHLFRGFSFVASSLIQEPSQQDLHKVPVHPIVQQLHGNNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDVLCTITKTMDYLHSQGVVHRDLKPSNILYRDESGSPESIRVCDFGFAKQLRAGNGLLMTPCYTANFVAPEVLKRQGYDAACDIWSLGILLYTMLAGFTPFANGPDDTPEEILARIGSGKYALSGGNWDSISDAAKDVVSKMLHVDPHQRLTAMQVLKHPWVVNREYLSPNQLSRQDVHLVKGAMAATYFALNRTPQAPRLEPVLSSNLAQRRGMKRLTSTRL

SEQ ID NO: 8247 - protein, 295 aa, Homo sapiens [sequence omitted]

SEQ ID NO: 8248 - protein, 264 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFTATQPEVADWSEGVQVPSVPIQQFPT

SEQ ID NO: 8249 - protein, 485 aa, Homo sapiens
MGEPGFFVTGDRAGGRSWCLRRVGMSAGWLLLEDGCEVTVGRGFGVTYQLVSKICPLMISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEHWALMEELNRSKKDFEAIIQAKNKELEQTKEEKEKMQAQKEEVLSHMNDVLENELQCIICSEYFIEAVTLNCAHSFCSYCINEWMKRKIECPICRKDIKSKTYSLVLDNCINKMVNNLSSEVKERRIVLIRERKAKRLF

SEQ ID NO: 8250 - protein, 98 aa, Homo sapiens
MGEPGFFVTGDRAGGRSWCLRRVGMSAGWLLLEDGCEVTVGRGFGVTYQLVSKICPLMISRNHCVLKQNPEGQWTIMDNKSFPSEKAEDFTAAGERFL

SEQ ID NO: 8251 - protein, 448 aa, Homo sapiens
MGEPGFFVTGDRAGGRSWCLRRVGMSAGWLLLEDGCEVTVGRGFGVTYQLVSKICPLMISRNHCVLKQNPEGQWTIMDNKSLNGVWLNRARLEPLRVYSIHQGDYIQLGVPLENKENAEYEYEVTEEDWETIYPCLSPKNDQMIEKNKELRTKRKFSLDELAGPGAEGPSNLKSKINKVSCESGQPVKSQGKGEVASTPSDNLDPKLTALEPSKTTGAPIYPGFPKVTEVHHEQKASNSSASQRSLQMFKVTMSRILRLKIQMQEKHEAVMNVKKQTQKGNSKKVVQMEQELQDLQSQLCAEQAQQQARVEQLEKTFQEEEQHLQGLEIAQGEKDLKQQLAQALQEHWALMEELNRSKKDFEAIIQAKNKELEQTKEEKEKMQAQKEEVLSHMNDVLENELQCIICSEYFIEQRDCSEDRALRAFERLPGSASLRWSGGFSLAVTPLL

SEQ ID NO: 8252 - protein, 530 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 8253 - protein, 423 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEALFVIMFWNEIWSDNMITLQL

SEQ ID NO: 8254 - protein, 524 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVADLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 8255 - protein, 231 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEK

SEQ ID NO: 8256 - protein, 373 aa, Homo sapiens
MQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 8257 - protein, 193 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRS

SEQ ID NO: 8258 - protein, 337 aa, Homo sapiens
  MOD_RES (1)..(1): Any amino acid
XSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIA

SEQ ID NO: 8259 - protein, 508 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 8260 - protein, 391 aa, Homo sapiens
MVEADRPGKLFIGGLNTETNEKALEAVFGKYGRIVEVLLMKDRETNKSRGFAFVTFESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 8261 - protein, 102 aa, Homo sapiens
  MOD_RES (1)..(1): Any amino acid
XMFICPQEMMGILLKTAIQAEITQVLVILEIMHHHHEIILTVIMVIPVHVMTIHQEDIAIEMDMVVIVTIQIIQVEVPTEIHMRVMVGDFAHYGRGVLIDSQ

SEQ ID NO: 8262 - protein, 196 aa, Homo sapiens
MVEADRPGKLFIGGLNTETNEKALEAVFGKYGRIVEVLLMKDRETNKSRGFAFVTFESPADAKDAARDMNGKLLYHVEEIVMEVHLEGNRCPLVEMFICPQEMMGILLKTAIQAEITQVLVILEIMHHHHEIILTVIMVIPVHVMTIHQEDIAIEMDMVVIVTIQIIQVEVPTEIHMRVMVGDFAHYGRGVLIDSQ

SEQ ID NO: 8263 - protein, 378 aa, Homo sapiens
MVEADRPGKLFIGGLNTETNEKALEAVFGKYGRIVEVLLMKDRESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSRGYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 8264 - protein, 480 aa, Homo sapiens
MASDSIFESFPSYPQCFMRECILGMNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 8265 - protein, 468 aa, Homo sapiens
MPAAPRGPAQGEAAARTRSRDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 8266 - protein, 453 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 8267 - protein, 475 aa, Homo sapiens
MNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMARASCSRQARRDPGPWARPPSWGRGRPTARISL

SEQ ID NO: 8268 - protein, 32 aa, Homo sapiens
MASDSIFESFPSYPQCFMRECILGMNPSRDVH

SEQ ID NO: 8269 - protein, 137 aa, Homo sapiens
MQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSY

SEQ ID NO: 8270 - protein, 480 aa, Homo sapiens; identical to SEQ ID NO: 8264

SEQ ID NO: 8271 - protein, 191 aa, Homo sapiens
MNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRNSLTWPRYPHI

SEQ ID NO: 8272 - protein, 250 aa, Homo sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQEEDTAPWRC

SEQ ID NO: 8273 - protein, 589 aa, Homo sapiens
MLHSPHKQPQNHKCGANFLQEDSKKSLVFKWLISAGHYQPPRPTESFKAASSIYNRGYKFYLKKKGGTMASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 8274 - protein, 507 aa, Homo sapiens
MRIPVDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 8275 - protein, 485 aa, Homo sapiens
MRIPVDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 8276 - protein, 499 aa, Homo sapiens
MASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 8277 - protein, 521 aa, Homo sapiens
MASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 8278 - protein, 521 aa, Homo sapiens; identical to SEQ ID NO: 8277

SEQ ID NO: 8279 - protein, 567 aa, Homo sapiens
MLHSPHKQPQNHKCGANFLQEDSKKSLVFKWLISAGHYQPPRPTESFKAASSIYNRGYKFYLKKKGGTMASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 8280 - protein, 415 aa, Homo sapiens
MRIPVDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 8281 - protein, 429 aa, Homo sapiens
MASNSIFDSFPTYSPTFIRDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 8282 - protein, 429 aa, Homo sapiens; identical to SEQ ID NO: 8281

SEQ ID NO: 8283 - protein, 362 aa, Homo sapiens
MRIPVDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 8284 - protein, 322 aa, Homo sapiens
MVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 8285 - protein, 812 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCDDCKGKRHLDAHPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 8286 - protein, 702 aa, Homo sapiens
MSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKWKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 8287 - protein, 785 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 8288 - protein, 257 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCKSQSFKTQKKVCFPNLIFPFCKSQCLHYLSWRLKIIP

SEQ ID NO: 8289 - protein, 822 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 8290 - protein, 583 aa, Homo sapiens
MKLSYESENYKLKTHESKDCESESYKSKSHESKAHASYYGRMNVREVLREDGHLSVNGEALWKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASTDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 8291 - protein, 113 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTS

SEQ ID NO: 8292 - protein, 88 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAA

SEQ ID NO: 8293 - protein, 702 aa, Homo sapiens; identical to SEQ ID NO: 8286

SEQ ID NO: 8294 - protein, 174 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGA

SEQ ID NO: 8295 - protein, 135 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVL

SEQ ID NO: 8296 - protein, 88 aa, Homo sapiens; identical to SEQ ID NO: 8292

SEQ ID NO: 8297 - protein, 682 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGKAASGVFWWLGIGWYQFVTLISWLNVFLLTRCLRNICKFLVLLIPLFLLLGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 8298 - protein, 974 aa, Homo sapiens
MGDVRKAKEALAEVQIPPPDAGPSPRCKPPPAERLLGPGRRRRGLRRRREAVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCGASFYVNRILWLARYTASSFSSFLVQLFQVVLMKLSYESENYKLKTHESKDCESESYKSKSHESKAHASYYGRMNVREVLREDGHLSVNGEALCDDCKGKRHLDAHTAAHSQSPRLPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 8299 - protein, 278 aa, Homo sapiens
MGRISPGSPGLPRTVWFEVVNMDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCKSQSFKTQKKVCFPNLIFPFCKSQCLHYLSWRLKIIP

SEQ ID NO: 8300 - protein, 119 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHG

SEQ ID NO: 8301 - protein, 783 aa, Homo sapiens
MVIMSEFSADPAGQGQGQQKPLRVGFYDIERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHHIVHRDLKTENLLLDGNMDIKLADFGFGNFYKSGEPLSTWCGSPPYAAPEVFEGKEYEGPQLDIWSLGVVLYVLVCGSLPFDGPNLPTLRQRVLEGRFRIPFFMSQDCESLIRRMLVVDPARRITIAQIRQHRWMRAEPCLPGPACPAFSAHSYTSNLGDYDEQALGIMQTLGVDRQRTVESLQNSSYNHFAAIYYLLLERLKEYRNAQCARPGPARQPRPRSSDLSGLEVPQEGLSTDPFRPALLCPQPQTLVQSVLQAEMDCELQSSLQWPLFFPVDASCSGVFRPRPVSPSSLLDTAISEEARQGPGLEEEQDTQESLPSSTGRRHTLAEVSTRLSPLTAPCIVVSPSTTASPAEGTSSDSCLTFSASKSPAGLSGTPATQGLLGACSPVRLASPFLGSQSATPVLQAQGGLGGAVLLPVSFQEGRRASDTSLTQGLKAFRQQLRKTTRTKGFLGLNKIKGLARQVCQAPASRASRGGLSPFHAPAQSPGLHGGAAGSREGWSLLEEVLEQQRLLQLQHHPAAAPGCSQAPQPAPAPFVIAPCDGPGAAPLPSTLLTSGLPLLPPPLLQTGASPVASAAQLLDTHLHIGTGPTALPAVPPPRLARLAPGCEPLGLLQGDCEMEDLMPCSLGTFVLVQ

SEQ ID NO: 8302 - protein, 1247 aa, Homo sapiens
MEDAGAAGPGPEPEPEPEPEPEPAPEPEPEPKPGAGTSEAFSRLWTDVMGILDGSLGNIDDLAQQYADYYNTCFSDVCERMEELRKRRVSQDLEVEKPDASPTSLQLRSQIEESLGFCSAVSTPEVERKNPLHKSNSEDSSVGKGDWKKKNKYFWQNFRKNQKGIMRQTSKGEDVGYVASEITMSDEERIQLMMMVKEKMITIEEALARLKEYEAQHRQSAALDPADWPDGSYPTFDGSSNCNSREQSDDETEESVKFKRLHKLVNSTRRVRKKLIRVEEMKKPSTEGGEEHVFENSPVLDERSALYSGVHKKPLFFDGSPEKPPEDDSDSLTTSPSSSSLDTWGAGRKLVKTFSKGESRGLIKPPKKMGTFFSYPEEEKAQKVSRSLTEGEMKKGLGSLSHGRTCSFGGFDLTNRSLHVGSNNSDPMGKEGDFVYKEVIKSPTASRISLGKKVKSVKETMRKRMSKKYSSSVSEQDSGLDGMPGSPPPSQPDPEHLDKPKLKAGGSVESLRSSLSGQSSMSGQTVSTTDSSTSNRESVKSEDGDDEEPPYRGPFCGRARVHTDFTPSPYDTDSLKLKKGDIIDIISKPPMGTWMGLLNNKVGTFKFIYVDVLSEDEEKPKRPTRRRRKGRPPQPKSVEDLLDRINLKEHMPTFLFNGYEDLDTFKLLEEEDLDELNIRDPEHRAVLLTAVELLQEYDSNSDQSGSQEKLLVDSQGLSGCSPRDSGCYESSENLENGKTRKASLLSAKSSTEPSLKSFSRNQLGNYPTLPLMKSGDALKQGQEEGRLGGGLAPDTSKSCDPPGVTGLNKNRRSLPVSICRSCETLEGPQTVDTWPRSHSLDDLQVEPGAEQDVPTEVTEPPPQIVPEVPQKTTASSTKAQPLEQDSAVDNALLLTQSKRFSEPQKLTTKKLEGSIAASGRGLSPPQCLPRNYDAQPPGAKHGLARTPLEGHRKGHEFEGTHHPLGTKEGVDAEQRMQPKIPSQPPPVPAKKSRERLANGLHPVPMGPSGALPSPDAPCLPVKRGSPASPTSPSDCPPALAPRPLSGQAPGSPPSTRPPPWLSELPENTSLQEHGVKLGPALTRKVSCARGVDLETLTENKLHAEGIDLTEEPYSDKHGRCGIPEALVQRYAEDLDQPERDVAANMDQIRVKQLRKQHRMAIPSGGLTEICRKPVSPGCISSVSDWLISIGLPMYAGTLSTAGFSTLSQVPSLSHTCLQEAGITEERHIRKLLSAARLFKLPPGPEAM

SEQ ID NO: 8303 - protein, 84 aa, Homo sapiens
MEEQDCRDGSLGNIDDLAQQYADYYNTCFSDVCERMEELRKRRVSQDLEVEKPDASPTSLQLRSQIEESLGFCSAVSTPEVERK

SEQ ID NO: 8304 - protein, 82 aa, Homo sapiens
QAQDFKDGSLGNIDDLAQQYADYYNTCFSDVCERMEELRKRRVSQDLEVEKPDASPTSLQLRSQIEESLGFCSAVSTPEVER

SEQ ID NO: 8305 - protein, 696 aa, Homo sapiens
MPKPSREQSDDETEESVKFKRLHKLVNSTRRVRKKLIRVEEMKKPSTEGGEEHVFENSPVLDERSALYSGVHKKPLFFDGSPEKPPEDDSDSLTTSPSSSSLDTWGAGRKLVKTFSKGESRGLIKPPKKMGTFFSYPEEEKAQKVSRSLTEGEMKKGLGSLSHGRTCSFGGFDLTNRSLHVGSNNSDPMGKEGDFVYKEVIKSPTASRISLGKKVKSVKETMRKRMSKKYSSSVSEQDSGLDGMPGSPPPSQPDPEHLDKPKLKAGGSVESLRSSLSGQSSMSGQTVSTTDSSTSNRESVKSEDGDDEEPPYRGPFCGRARVHTDFTPSPYDTDSLKLKKGDIIDIISKPPMGTWMGLLNNKVGTFKFIYVDVLSEDEEKPKRPTRRRRKGRPPQPKSVEDLLDRINLKEHMPTFLFNGYEDLDTFKLLEEEDLDELNIRDPEHRAVLLTAVELLQEYDSNSDQSGSQEKLLVDSQGLSGCSPRDSGCYESSENLENGKTRKASLLSAKSSTEPSLKSFSRNQLGNYPTLPLMKSGDALKQGQEEGRLGGGLAPDTSKSCDPPGVTGLNKNRRSLPVSICRSCETLEGPQTVDTWPRSHSLDDLQVEPGAEQDVPTEVTEPPPQIVPEVPQKTTASSTKAQPLEQDSAVDNALLLTQSKRFSEPQKLTTKKLEGSIAASGRGLSPPQCLPRNYDAQ

SEQ ID NO: 8306 - protein, 657 aa, Homo sapiens
MGTWMGLLNNKVGTFKFIYVDVLSEDEEKPKRPTRRRRKGRPPQPKSVEDLLDRINLKEHMPTFLFNGYEDLDTFKLLEEEDLDELNIRDPEHRAVLLTAVELLQEYDSNSDQSGSQEKLLVDSQGLSGCSPRDSGCYESSENLENGKTRKASLLSAKSSTEPSLKSFSRNQLGNYPTLPLMKSGDALKQGQEEGRLGGGLAPDTSKSCDPPGVTGLNKNRRSLPVSICRSCETLEGPQTVDTWPRSHSLDDLQVEPGAEQDVPTEVTEPPPQIVPEVPQKTTASSTKAQPLEQDSAVDNALLLTQSKRFSEPQKLTTKKLEGSIAASGRGLSPPQCLPRNYDAQPPGAKHGLARTPLEGHRKGHEFEGTHHPLGTKEGVDAEQRMQPKIPSQPPPVPAKKSRERLANGLHPVPMGPSGALPSPDAPCLPVKRGSPASPTSPSDCPPALAPRPLSGQAPGSPPSTRPPPWLSELPENTSLQEHGVKLGPALTRKVSCARGVDLETLTENKLHAEGIDLTEEPYSDKHGRCGIPEALVQRYAEDLDQPERDVAANMDQIRVKQLRKQHRMAIPSGGLTEICRKPVSPGCISSVSDWLISIGLPMYAGTLSTAGFSTLSQVPSLSHTCLQEAGITEERHIRKLLSAARLFKLPPGPEAM

SEQ ID NO: 8307 - protein, 206 aa, Homo sapiens
MLPPAIHFYLLPLACILMKSCLAFKNDATEILYSHVVKPVPAHPSSNSTLNQARNGGRHFSNTGLDRNTRVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 8308 - protein, 230 aa, Homo sapiens
MLPPAIHFYLLPLACILMKSCLAFKNDATEILYSHVVKPVPAHPSSNSTLNQARNGGRHFSNTGLDRNRTESLTRQNYFWLFPGAFLRQLQEARVQVGCRELRSTKYISDGQCTSISPLKELVCAGECLPLPVLPNWIGGGYGTKYWSRRSSQEWRCVNDKTRTQRIQLQCQDGSTRTYKITVVTACKCKRYTRQHNESSHNFESMSPAKPVQHHRERKRASKSSKHSMS

SEQ ID NO: 8309 - protein, 742 aa, Homo sapiens
MGSENSALKSYTLREPPFTLPSGLAVYPAVLQDGKFASVFVYKRENEDKVNKAAKHLKTLRHPCLLRFLSCTVEADGIHLVTERVQPLEVALETLSSAEVCAGIYDILLALIFLHDRGHLTHNNVCLSSVFVSEDGHWKLGGMETVCKVSQATPEFLRSIQSIRDPASIPPEEMSPEFTTLPECHGHARDAFSFGTLVESLLTILNEQVSADVLSSFQQTLHSTLLNPIPKCRPALCTLLSHDFFRNDFLEVVNFLKSLTLKSEEEKTEFFKFLLDRVSCLSEELIASRLVPLLLNQLVFAEPVAVKSFLPYLLGPKKDHAQGETPCLLSPALFQSRVIPVLLQLFEVHEEHVRMVLLSHIEAYVEHFTQEQLKKVILPQVLLGLRDTSDSIVAITLHSLAVLVSLLGPEVVVGGERTKIFKRTAPSFTKNTDLSLEDSPMCVVCSHHSQISPILENPFSSIFPKCFFSGSTPINSKKHIQRDYYNTLLQTGDPFSQPIKFPINGLSDVKNTSEDSENFPSSSKKSEEWPDWSEPEEPENQTVNIQIWPREPCDDVKSQCTTLDVEESSWDDCEPSSLDTKVNPGGGITATKPVTSGEQKPIPALLSLTEESMPWKSSLPQKISLVQRGDDADQIEPPKVSSQERPLKVPSELGLGEEFTIQVKKKPVKDPEMDWFADMIPEIKPSAAFLILPELRTEMVPKKDDVSPVMQFSSKFAAAEITEGEAEGWEEEGELNWEDNNW

SEQ ID NO: 8310 - protein, 688 aa, Homo sapiens
MGSENSALKSYTLREPPFTLPSGLAVYPAVLQDGKFASVFVYKRENEDKVNKAAKHLKTLRHPCLLRFLSCTVEADGIHLVTERVQPLEVALETLSSAEVCAGIYDILLALIFLHDRGHLTHNNVCLSSVFVSEDGHWKLGGMETVCKVSQATPEFLRSIQSIRDPASIPPEEMSPEFTTLPECHGHARDAFSFGTLVESLLTILNEQVSADVLSSFQQTLHSTLLNPIPKCRPALCTLLSHDFFRNDFLEVVNFLKSLTLKSEEEKTEFFKFLLDRVSCLSEELIASRLVPLLLNQLVFAEPVAVKSFLPYLLGPKKDHAQGETPCLLSPALFQSRVIPVLLQLFEVHEEHVRMVLLSHIEAYVEHFTQEQLKKVILPQVLLGLRDTSDSIVAITLHSLAVLVSLLGPEVVVGGERTKIFKRTAPSFTKNTDLSLEGDPFSQPIKFPINGLSDVKNTSEDSENFPSSSKKSEEWPDWSEPEEPENQTVNIQIWPREPCDDVKSQCTTLDVEESSWDDCEPSSLDTKVNPGGGITATKPVTSGEQKPIPALLSLTEESMPWKSSLPQKISLVQRGDDADQIEPPKVSSQERPLKVPSELGLGEEFTIQVKKKPVKDPEMDWFADMIPEIKPSAAFLILPELRTEMVPKKDDVSPVMQFSSKFAAAEITEGEAEGWEEEGELNWEDNNW

SEQ ID NO: 8311 - protein, 742 aa, Homo sapiens; identical to SEQ ID NO: 8309

SEQ ID NO: 8312 - protein, 588 aa, Homo sapiens
MGSENSALKSYTLREPPFTLPSGLAVYPAVLQDGKFASVFVYKRENEDKVNKAAKHLKTLRHPCLLRFLSCTVEADGIHLVTERVQPLEVALETLSSAEVCAGIYDILLALIFLHDRGHLTHNNVCLSSVFVSEDGHWKLGGMETVCKVSQATPEFLRSIQSIRDPASIPPEEMSPEFTTLPECHGHARDAFSFGTLVESLLTILNEQVSADVLSSFQQTLHSTLLNPIPKCRPALCTLLSHDFFRNDFLEVVNFLKSLTLKSEEEKTEFFKFLLDRVSCLSEELIASRLVPLLLNQLVFAEPVAVKSFLPYLLGPKKDHAQGETPCLLSPALFQSRVIPVLLQLFEVHEEHVRMVLLSHIEAYVEHFTQEQLKKVILPQVLLGLRDTSDSIVAITLHSLAVLVSLLGPEVVVGGERTKIFKRTAPSFTKNTDLSLEGDPFSQPIKFPINGLSDVKNTSEDSENFPSSSKKSEEWPDWSEPEEPENQTVNIQIWPREPCDDVKSQCTTLDVEESSWDDCEPSSLDTKVNPGGGITATKPVTSGEQKPIPALLSLTEESMPWKSSLPQKISLVQRGDDADQIEPPKVSS

SEQ ID NO: 8313 - protein, 314 aa, Homo sapiens
MGIGRSEGGRRGAALGVLLALGAALLAVGSASEYDYVSFQSDIGPYQSGRFYTKPPQCVDIPADLRLCHNVGYKKMVLPNLLEHETMAEVKQQASSWVPLLNKNCHAGTQVFLCSLFAPVCLDRPIYPCRWLCEAVRDSCEPVMQFFGFYWPEMLKCDKFPEGDVCIAMTPPNATEASKPQGTTVCPPCDNELKSEAIIEHLCASEFALRMKIKEVKKENGDKKIVPKKKKPLKLGPIKKKDLKKLVLYLKNGADCPCHQLDNLSHHFLIMGRKVKSQYLLTAIHKWDKKNKEFKNFMKKMKNHECPTFQSVFK

SEQ ID NO: 8314 - protein, 314 aa, Homo sapiens; identical to SEQ ID NO: 8313

SEQ ID NO: 8315 - protein, 346 aa, Homo sapiens
MFLSILVALCLWLHLALGVRGAPCEAVRIPMCRHMPWNITRMPNHLHHSTQENAILAIEQYEELVDVNCSAVLRFFLCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 8316 - protein, 343 aa, Homo sapiens
MRVAGREGRFLSAGVAAREGSAMFLSILVALCLWLHLALGVRGAPCEAVRIPMCRHMPWNITRMPNHLHHSTQENAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 8317 - protein, 317 aa, Homo sapiens
MRAAAAGGGVRTAALALLLGALHWAPARCEEYDYYGWQAEPLHGRSYSKPPQCLDIPADLPLCHTVGYKRMRLPNLLEHESLAEVKQQASSWLPLLAKRCHSDTQVFLCSLFAPVCLDRPIYPCRSLCEAVRAGCAPLMEAYGFPWPEMLHCHKFPLDNDLCIAVQFGHLPATAPPVTKICAQCEMEHSADGLMEQMCSSDFVVKMRIKEIKIENGDRKLIGAQKKKKLLKPGPLKRKDTKRLVLHMKNGAGCPCPQLDSLAGSFLVMGRKVDGQLLLMAVYRWDKKNKEMKFAVKFMFSYPCSLYYPFFYGAAEPH

SEQ ID NO: 8318 - protein, 300 aa, Homo sapiens
MRIAVICFCLLGITCAIPVKQADSGSSEEKQLYNKYPDAVATWLNPDPSQKQNLLAPQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 8319 - protein, 292 aa, Homo sapiens
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 8320 - protein, 287 aa, Homo sapiens
MRIAVICFCLLGITCAIPVKQADSGSSEEKQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 8321 - protein, 314 aa, Homo sapiens
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 8322 - protein, 273 aa, Homo sapiens
MRIAVICFCLLGITCAIPVKQADSGSSEEKQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 8323 - protein, 303 aa, Homo sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 8324 - protein, 53 aa, Homo sapiens
MRAWIFFLLCLAGRALAAPQQEALPDETEVVEETVAEVTEVSVGANPVQVEVG

SEQ ID NO: 8325 - protein, 111 aa, Homo sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKV

SEQ ID NO: 8326 - protein, 91 aa, Homo sapiens
MKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 8327 - protein, 459 aa, Homo sapiens
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 8328 - protein, 478 aa, Homo sapiens
MDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 8329 - protein, 459 aa, Homo sapiens; identical to SEQ ID NO: 8327

SEQ ID NO: 8330 - protein, 470 aa, Homo sapiens
MPGFYSVMTDEEIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 8331 - protein, 274 aa, Homo sapiens
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCH

SEQ ID NO: 8332 - protein, 492 aa, Homo sapiens
YSSPALFSSRAAPQKPRKEGSQAAGLLVFSDSLEIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 8333 - protein, 331 aa, Homo sapiens
MVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 8334 - protein, 436 aa, Homo sapiens
MSVSARSAAAEERSVNSSTMGQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 8335 - protein, 438 aa, Homo sapiens
MSVSARSAAAEERSVNSSTMEVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 8336 - protein, 436 aa, Homo sapiens
MSVSARSAAAEERSVNSSTMVQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 8337 - protein, 88 aa, Homo sapiens
MKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 8338 - protein, 384 aa, Homo sapiens
MVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 8339 - protein, 235 aa, Homo sapiens
MSVSARSAAAEERSVNSSTMGQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETAKKKKKKK

SEQ ID NO: 8340 - protein, 384 aa, Homo sapiens; identical to SEQ ID NO: 8338

SEQ ID NO: 8341 - protein, 381 aa, Homo sapiens
VTHETIVEQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAEVISLISHLLADIVFLFK

SEQ ID NO: 8342 - protein, 382 aa, Homo sapiens
MGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGVAEVENGEHCDFTILRNMLIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 8343 - protein, 433 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 8344 - protein, 432 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEAGPPTLPARPAASSKIRRLSACKQQ

SEQ ID NO: 8345 - protein, 415 aa, Homo sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 8346 - protein, 113 aa, Homo sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSA

SEQ ID NO: 8347 - protein, 161 aa, Homo sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLEC

SEQ ID NO: 8348 - protein, 132 aa, Homo sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGE

SEQ ID NO: 8349 - protein, 415 aa, Homo sapiens; identical to SEQ ID NO: 8345

SEQ ID NO: 8350 - protein, 402 aa, Homo sapiens [sequence omitted]

SEQ ID NO: 8351 - protein, 387 aa, Homo sapiens
MQMSPALTCLVLGLALVFGEGSAVHHPPSYVAQASKDRNVVFSPYGVASVLAMLQLTTGGETQQQIQAAMGFKIDDKGMAPALRHLYKELMGPWNKDEISTTDAIFVQRDLKLVQGFMPHFFRLFRSTVKQVDFSEVERARFIINDWVKTHTKGMISNLLGKGAVDQLTRLVLVNALYFNGQWKTPFPDSSTHRRLFHKSDGSTVSVPMMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 8352 - protein, 179 aa, Homo sapiens
MMAQTNKFNYTEFTTPDGHYYDILELPYHGDTLSMFIAAPYEKEVPLSALTNILSAQLISHWKGNMTRLPRLLVLPKFSLETEVDLRKPLENLGMTDMFRQFQADFTSLSDQEPLHVAQALQKVKIEVNESGTVASSSTAVIVSARMAPEEIIMDRPFLFVVRHNPTGTVLFMGQVMEP

SEQ ID NO: 8353 - protein, 236 aa, Homo sapiens [sequence omitted]

SEQ ID NO: 8354 - protein, 508 aa, Homo sapiens
MLPTQAGAAAALGRGSALGGSLNRTPTGRPGGGGGTRGANGGRVPGNGAGLGPGRLEREAAAAAATTPAPTAGALYSGSEGDSESGEEEELGAERRGLKRSLSEMEIGMVVGGPEASAAATGGYGPVSGAVSGAKPGKKTRGRVKIKMEFIDNKLRRYTTFSKRKTGIMKKAYELSTLTGTQVLLLVASETGHVYTFATRKLQPMITSETGKALIQTCLNSPDSPPRSDPTTDQRMSATGFEETDLTYQVSESDSSGETKDTLKPAFTVTNLPGTTSTIQTAPSTSTTMQVSSGPSFPITNYLAPVSASVSPSAVSSANGTVLKSTGSGPVSSGGLMQLPTSFTLMPGGAVAQQVPVQAIQVHQAPQQASPSRDSSTDLTQTSSSGTVTLPATIMTSSVPTTVGGHMMYPSPHAVMYAPTSGLGDGSLTVLNAFSQAPSTMQVSHSQVQEPGGVPQVFLTASSGTVQIPVSAVQLHQMAVIGQQAGSSSNLTELQVVNLDTAHSTKSE

SEQ ID NO: 8355 - protein, 304 aa, Homo sapiens
MITSETGKALIQTCLNSPDSPPRSDPTTDQRMSATGFEETDLTYQVSESDSSGETKDTLKPAFTVTNLPGTTSTIQTAPSTSTTMQVSSGPSFPITNYLAPVSASVSPSAVSSANGTVLKSTGSGPVSSGGLMQLPTSFTLMPGGAVAQQVPVQAIQVHQAPQQASPSRDSSTDLTQTSSSGTVTLPATIMTSSVPTTVGGHMMYPSPHAVMYAPTSGLGDGSLTVLNAFSQAPSTMQVSHSQVQEPGGVPQVFLTASSGTVQIPVSAVQLHQMAVIGQQAGSSSNLTELQVVNLDTAHSTKSE

SEQ ID NO: 8356 - protein, 277 aa, Homo sapiens
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 8357 - protein, 265 aa, Homo sapiens
MPRSHQPPPPPHEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 8358 - protein, 266 aa, Homo sapiens
MMPRSHQPPPPPHEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 8359 - protein, 290 aa, Homo sapiens
MAPKRQSPLPPQKKKPRPPPALGPEETSASAGLPKKGEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 8360 - protein, 268 aa, Homo sapiens
MGCRDLLPSLKPTLLEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 8361 - protein, 32 aa, Homo sapiens
MAPKRQSPLPPQKKKPRPPPALGPEETSASAG

SEQ ID NO: 8362 - protein, 313 aa, Homo sapiens
MTGKATPPSLYSWRGVLFTCLPAARTRKRKEMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 8363 - protein, 298 aa, Homo sapiens
MVIIIFLLPPYVFISEMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 8364 - protein, 282 aa, Homo sapiens
MSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 8365 - protein, 235 aa, Homo sapiens
MTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 8366 - protein, 402 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 8367 - protein, 293 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 8368 - protein, 239 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQLVPALDGCLRRDSWLDKQAEISASAPTSLRSCDVESNPGIFLPPGTQAEFNLRDIPQPHAEPWAFSLDLGLKQAAGSGHLLALGTPENPSWLSLHLQDQEKTLPPLFA

SEQ ID NO: 8369 - protein, 287 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPLVPALDGCLRRDSWLDKQAEISASAPTSLRSCDVESNPGIFLPPGTQAEFNLRGEDSSTSFCLNGLWAQGQRLDVDQALNRSHEIWTHSCPQSPGNGTDASH

SEQ ID NO: 8370 - protein, 140 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQEKTLPPLFA

SEQ ID NO: 8371 - protein, 384 aa, Homo sapiens
MESRGPLATSRLLLLLLLLLLRHTRQGWALRPVLPTQSAHDPPAVHLSNGPGQEPIAVMTFDLTKITKTSSSFEVRTWDPEGVIFYGDTNPKDDWFMLGLRDGRPEIQLHNHWAQLTVGAGPRLDDGRWHQVEVKMEGDSVLLEVDGEEVLRLRQVSGPLTSKRHPIMRIALGGLLFPASNLRLPAEISASAPTSLRSCDVESNPGIFLPPGTQAEFNLRDIPQPHAEPWAFSLDLGLKQAAGSGHLLALGTPENPSWLSLHLQDQKVVLSSGSGPGLDLPLVLGLPLQLKLSMSRVVLSQGSKMKALALPPLGLAPLLNLWAKPQGRLFLGALPGEDSSTSFCLNGLWAQGQRLDVDQALNRSHEIWTHSCPQSPGNGTDASH

SEQ ID NO: 8372 - protein, 371 aa, Homo sapiens
MSPSTFQITDMTRRSCQNLGYTAASPQAPEAASNTGNAERAEEVPGEGSLFLQAETRAWFQKTQAHWLLQHGAAPAWFHGFITRREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 8373 - protein, 389 aa, Homo sapiens
MEFPLAQICPQGSHEAPIPTFSTFQITDMTRRSCQNLGYTAASPQAPEAASNTGNAERAEEVPGEGSLFLQAETRAWFQKTQAHWLLQHGAAPAWFHGFITRREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 8374 - protein, 399 aa, Homo sapiens
MEFPLAQICPQGSHEAPIPTFSTFQITDMTRRSCQNLGYTAASPQAPEAASNTGNAERAEEVPGEGSLFLQAETRAWFQKTQAHWLLQHGAAPAWFHGFITRRVRPPLSVTHREAERLLEPKPQGCYLVRFSESAVTFVLTYRSRTCCRHFLLAQLRDGRHVVLGEDSAHARLQDLLLHYTAHPLSPYGETLTEPLARQTPEPAGLSLRTEESNFGSKSQDPNPQYSPIIKQGQAPVPMQKEGAGEKEPSQLLRPKPPIPAKPQLPPEVYTIPVPRHRPAPRPKPSNPIYNEPDEPIAFYAMGRGSPGEAPSNIYVEVEDEGLPATLGHPVLRKSWSRPVPGGQNTGGSQLHSENSVIGQGPPLPHQPPPAWRHTLPHNLSRQVLQDRGQAWLPLGPPQ

SEQ ID NO: 8375 - protein, 940 aa, Homo sapiens
MILEQYVVVSNYKKQENSELSLQAGEVVDVIEKNESGWWFVSTSEEQGWVPATYLEAQNGTRDDSDINTSKTGEEEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 8376 - protein, 1105 aa, Homo sapiens
MLAYCVQDATVVDVEKRRNPSKHYVYIINVTWSDSTSQTIYRRYSKFFDLQMQLLDKFPIEGGQKDPKQRIIPFLPGKILFRRSHIRDVAVKRLKPIDEYCRALVRLPPHISQCDEVFRFFEARPEDVNPPKEDYGSSKRKSVWLSSWAESPKKDVTGADATAEPMILEQYVVVSNYKKQENSELSLQAGEVVDVIEKNESGWWFVSTSEEQGWVPATYLEAQNGTRDDSDINTSKTGEEEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 8377 - protein, 1133 aa, Homo sapiens
MLAYCVQDATVVDVEKRRNPSKHYVYIINVTWSDSTSQTIYRRYSKFFDLQMQLLDKFPIEGGQKDPKQRIIPFLPGKILFRRSHIRDVAVKRLKPIDEYCRALVRLPPHISQCDEVFRFFEARPEDVNPPKEDYGSSKRKSVWLSSWAESPKKDVTGADATAEPMILEQYVVVSNYKKQENSELSLQAGEVVDVIEKNESGWWFVSTSEEQGWVPATYLEAQNGTRDDSDINTSKTGEVSKRRKAHLRRLDRRWTLGGMVNRQHSREEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 8378 - protein, 1060 aa, Homo sapiens
  MOD_RES (1)..(1): Any amino acid
XFFDLQMQLLDKFPIEGGQKDPKQRIIPFLPGKILFRRSHIRDVAVKRLKPIDEYCRALVRLPPHISQCDEVFRFFEARPEDVNPPKEDYGSSKRKSVWLSSWAESPKKDVTGADATAEPMILEQYVVVSNYKKQENSELSLQAGEVVDVIEKNESGWWFVSTSEEQGWVPATYLEAQNGTRDDSDINTSKTGEEEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 8379 - protein, 369 aa, Homo sapiens
MSICCCFFFRDYGSSKRKSGADATAEPMILEQYVVVSNYKKQENSELSLQAGEVVDVIEKNESGWWFVSTSEEQGWVPATYLEAQNGTRDDSDINTSKTGEVSKRRKAHLRRLDRRWTLGGMVNRQHSREEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLTESRCRQAGVQWHDLGSLQSPHPRFKRFSCLSLLSSWDHRHMPPHPANFLIFLIETGFHHVGQDGLHLLTS

SEQ ID NO: 8380 - protein, 965 aa, Homo sapiens
MPVTATGKILFRRSHIRDVAVKRLKPIDEYCRALVRLPPHISQCDEVFRFFEARPEDVNPPKEDYGSSKRKSGADATAEPMILEQYVVVSNYKKQENSELSLQAGEVVDVIEKNESGWWFVSTSEEQGWVPATYLEAQNGTRDDSDINTSKTGEVSKRRKAHLRRLDRRWTLGGMVNRQHSREEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPIEKSQFIHNNLKDVYVSIADYEGDEETAGFQEGVSMEVLERNPNGWWYCQILDGVKPFKGWVPSNYLEKKN

SEQ ID NO: 8381 - protein, 968 aa, Homo sapiens
MILEQYVVVSNYKKQENSELSLQAGEVVDVIEKNESGWWFVSTSEEQGWVPATYLEAQNGTRDDSDINTSKTGEVSKRRKAHLRRLDRRWTLGGMVNRQHSREEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 8382 - protein, 1000 aa, Homo sapiens
MNGSFLLRLLFPVASILPETVLLRGADATAEPMILEQYVVVSNYKKQENSELSLQAGEVVDVIEKNESGWWFVSTSEEQGWVPATYLEAQNGTRDDSDINTSKTGEVSKRRKAHLRRLDRRWTLGGMVNRQHSREEKYVTVQPYTSQSKDEIGFEKGVTVEVIRKNLEGWWYIRYLGKEGWAPASYLKKAKDDLPTRKKNLAGPVEIIGNIMEISNLLNKKASGDKETPPAEGEGHEAPIAKKEISLPILCNASNGSAVGVPDRTVSRLAQGSPAVARIAPQRAQISSPNLRTRPPPRRESSLGFQLPKPPEPPSVEVEYYTIAEFQSCISDGISFRGGQKAEVIDKNSGGWWYVQIGEKEGWAPASYIDKRKKPNLSRRTSTLTRPKVPPPAPPSKPKEAEEGPTGASESQDSPRKLKYEEPEYDIPAFGFDSEPELSEEPVEDRASGERRPAQPHRPSPASSLQRARFKVGESSEDVALEEETIYENEGFRPYAEDTLSARGSSGDSDSPGSSSLSLTRKNSPKSGSPKSSSLLKLKAEKNAQAEMGKNHSSASFSSSITINTTCCSSSSSSSSSLSKTSGDLKPRSASDAGIRGTPKVRAKKDADANAGLTSCPRAKPSVRPKPFLNRAESQSQEKMDISTLRRQLRPTGQLRGGLKGSKSEDSELPPQTASEAPSEGSRRSSSDLITLPATTPPCPTKKEWEGPATSYMTCSAYQKVQDSEISFPAGVEVQVLEKQESGWWYVRFGELEGWAPSHYLVLDENEQPDPSGKELDTVPAKGRQNEGKSDSLEKIERRVQALNTVNQSKKATPPIPSKPPGGFGKTSGTPAVKMRNGVRQVAVRPQSVFVSPPPKDNNLSCALRRNESLTATDGLRGVRRNSSFSTARSAAAEAKGRLAERAASQGSDSPLLPAQRNSIPVSPVRPKPIEKSQFIHNNLKDVYVSIADYEGDEETAGFQEGVSMEVLERNPNGWWYCQILDGVKPFKGWVPSNYLEKKN

SEQ ID NO: 8383 - protein, 137 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAAD

SEQ ID NO: 8384 - protein, 305 aa, Homo sapiens
MAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVRWGFAMLPKLFLNSRAQVIRLPRPPRVLGLQARTTMPSLHIFFCTVYTLLRHANFLQVKKGVYSSQLHSFRADVAFAFSHFTDLSIPTTVSF

SEQ ID NO: 8385 - protein, 520 aa, Homo sapiens
MSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 8386 - protein, 583 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 8387 - protein, 384 aa, Homo sapiens
MDLLPPKPKYNPLRNESLSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 8388 - protein, 473 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 8389 - protein, 474 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 8390 - protein, 200 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQDTAEYVAYVAKDPVNQRACHILECPEGLAQDVISTIGQAFELRFKQYLRNPPKLVTPHDR

SEQ ID NO: 8391 - protein, 200 aa, Homo sapiens
MPITLTVSTSSLNLMAADCKQDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPP

SEQ ID NO: 8392 - protein, 130 aa, Homo sapiens
MPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPP

SEQ ID NO: 8393 - protein, 297 aa, Homo sapiens
  MOD_RES (1)..(1): Any amino acid
XDEEEEEPPDHQYYNDFPGKEPPLGGVVDMRLREGAAPGAARPTAPNAQTPSHLGATLPVGQPVGGDPEVRKQMPPPPPCPGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVRWGFAMLPKLFLNSRAQVIRLPRPPRVLGLQARTTMPSLHIFFCTVYTLLRHANFLQVKKGVYSSQLHSFRADVAFAFSHFTDLSIPTTVSF

SEQ ID NO: 8394 - protein, 584 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 8395 - protein, 582 aa, Homo sapiens
MTQGPGGRAPPAPPAPPEPEAPTTFCALLPRMPQWKFAAPGGFLGRGPAAARAAGASGGADPQPEPAGPGGVPALAAAVLGACEPRCAAPCPLPALSRCRGAGSRGSRGGRGAAGSGDAAAAAEWIRKGSFIHKPAHGWLHPDARVLGPGVSYVVRYMGCIEVLRSMRSLDFNTRTQVTREAINRLHEAVPGVRGSWKKKAPNKALASVLGKSNLRFAGMSISIHISTDGLSLSVPATRQVIANHHMPSISFASGGDTDMTDYVAYVAKDPINQRACHILECCEGLAQSIISTVGQAFELRFKQYLHSPPKVALPPERLAGPEESAWGDEEDSLEHNYYNSIPGKEPPLGGLVDSRLALTQPCALTALDQGPSPSLRDACSLPWDVGSTGTAPPGDGYVQADARGPPDHEEHLYVNTQGLDAPEPEDSPKKDLFDMRPFEDALKLHECSVAAGVTAAPLPLEDQWPSPPTRRAPVAPTEEQLRQEPWYHGRMSRRAAERMLRADGDFLVRDSVTNPGQYVLTGMHAGQPKHLLLVDPEGVVRTKDVLFESISHLIDHHLQNGQPIVAAESELHLRGVVSREP

SEQ ID NO: 8396 - protein, 610 aa, Homo sapiens
MLDFFTIFSKGGLVLWCFQGVSDSCTGPVNALIRSVLLQVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 8397 - protein, 750 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 8398 - protein, 712 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEV

SEQ ID NO: 8399 - protein, 714 aa, Homo sapiens
MWMSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEV

SEQ ID NO: 8400 - protein, 750 aa, Homo sapiens; identical to SEQ ID NO: 8397

SEQ ID NO: 8401 - protein, 180 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNR

SEQ ID NO: 8402 - protein, 70 aa, Homo sapiens
MSQWYELQQLDSKFLEQVHQLYDDSFPMEIRQYLAQWLEKQDWEHAANDVSFATIRFHDLLSQLDDQYSR

SEQ ID NO: 8403 - protein, 193 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNRGSSSQNNRVAECH

SEQ ID NO: 8404 - protein, 150 aa, Homo sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVK

SEQ ID NO: 8405 - protein, 193 aa, Homo sapiens; identical to SEQ ID NO: 8403

SEQ ID NO: 8406 - protein, 160 aa, Homo sapiens
ECHEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPP

SEQ ID NO: 8407 - protein, 851 aa, Homo sapiens
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQPFSQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 8408 - protein, 460 aa, Homo sapiens
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKVSENGGQGERKQLWKKA

SEQ ID NO: 8409 - protein, 847 aa, Homo sapiens
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 8410 - protein, 770 aa, Homo sapiens
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 8411 - protein, 672 aa, Homo sapiens
MEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 8412 - protein, 769 aa, Homo sapiens
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGAAPYLKTKFICVTPTTCSNTIDLPMSPRTLDSLMQFGNNGEGAEPSAGGQFESLTFDMELTSECATSPM

SEQ ID NO: 8413 - protein, 722 aa, Homo sapiens
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPFIDAVWK

SEQ ID NO: 8414 - protein, 748 aa, Homo sapiens
MSQWNQVQQLEIKFLEQVDQFYDDNFPMEIRHLLAQWIENQDWEAASNNETMATILLQNLLIQLDEQLGRVSKEKNLLLIHNLKRIRKVLQGKFHGNPMHVAVVISNCLREERRILAAANMPVQGPLEKSLQSSSVSERQRNVEHKVAAIKNSVQMTEQDTKYLEDLQDEFDYRYKTIQTMDQSDKNSAMVNQEVLTLQEMLNSLDFKRKEALSKMTQIIHETDLLMNTMLIEELQDWKRRQQIACIGGPLHNGLDQLQNCFTLLAESLFQLRRQLEKLEEQSTKMTYEGDPIPMQRTHMLERVTFLIYNLFKNSFVVERQPCMPTHPQRPLVLKTLIQFTVKLRLLIKLPELNYQVKVKASIDKNVSTLSNRRFVLCGTNVKAMSIEESSNGSLSVEFRHLQPKEMKSSAGGKGNEGCHMVTEELHSITFETQICLYGLTIDLETSSLPVVMISNVSQLPNAWASIIWYNVSTNDSQNLVFFNNPPPATLSQLLEVMSWQFSSYVGRGLNSDQLHMLAEKLTVQSSYSDGHLTWAKFCKEHLPGKSFTFWTWLEAILDLIKKHILPLWIDGYVMGFVSKEKERLLLKDKMPGTFLLRFSESHLGGITFTWVDHSESGEVRFHSVEPYNKGRLSALPFADILRDYKVIMAENIPENPLKYLYPDIPKDKAFGKHYSSQPCEVSRPTERGDKGYVPSVFIPISTIRSDSTEPHSPSDLLPMSPSVYAVLRENLSPTTIETAMKSPYSAE

SEQ ID NO: 8415 - protein, 748 aa, Homo sapiens; identical to SEQ ID NO: 8414

SEQ ID NO: 8416 - protein, 117 aa, Homo sapiens
MSQWNQVQQLEIKFLEQVDQFYDDNFPMEIRHLLAQWIENQDWEAASNNETMATILLQNLLIQLDEQLGRVSKEKNLLLIHNLKRIRKVLQSPGLATAQLPLDRHGETCIQRSKSCP

SEQ ID NO: 8417 - protein, 25 aa, Homo sapiens
MSQWNQVQQLEIKFLEQVDQFYDDN

SEQ ID NO: 8418 - protein, 79 aa, Homo sapiens
MSQWNQVQQLEIKFLEQVDQFYDDNFPMEIRHLLAQWIENQDWEAASNNETMATILLQNLLIQLDEQLGRVSKEKNLLL

SEQ ID NO: 8419 - protein, 794 aa, Homo sapiens
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 8420 - protein, 125 aa, Homo sapiens
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANN

SEQ ID NO: 8421 - protein, 791 aa, Homo sapiens
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 8422 - protein, 765 aa, Homo sapiens
TAMAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 8423 - protein, 764 aa, Homo sapiens
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 8424 - protein, 764 aa, Homo sapiens; identical to SEQ ID NO: 8423

SEQ ID NO: 8425 - protein, 787 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENLPGRNYTFWQWFDGVMEVLKKHLKPHWNDGAILGFVNKQQAHDLLINKPDGTFLLRFSDSEIGGITIAWKFDSQERMFWNLMPFTTRDFSIRSLADRLGDLNYLIYVFPDRPKDEVYSKYYTPVPCESATAKAVDGYVKPQIKQVVPEFVNASADAGGGSATYMDQAPSPAVCPQAHYNMYPQNPDSVLDTDGDFDLEDTMDVARRVEELLGRPMDSQWIPHAQS

SEQ ID NO: 8426 - protein, 156 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQ

SEQ ID NO: 8427 - protein, 177 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEGPRQSMGHEIKSELLMGGCSWIRGKIQCDRVQVRRPGFSSQL

SEQ ID NO: 8428 - protein, 270 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAPSGRNLTPAELPAKQREQLLGICDAALCRQVQLLGVRLVVGVGRLAEQRARRALAGLMPEVQVEGLLHPSPRNPQANKGWEAVAKERLNELGLLPLLLK

SEQ ID NO: 8429 - protein, 270 aa, Homo sapiens; identical to SEQ ID NO: 8428

SEQ ID NO: 8430 - protein, 82 aa, Homo sapiens
MPQAFLLGSIHEPAGALMEPQPCPGSLAESFLEEELRLNAELSQLQFSEPVGIIYNPVEYAWEPHRNYVTRYCQGPKEVLFL

SEQ ID NO: 8431 - protein, 172 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAP

SEQ ID NO: 8432 - protein, 96 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGV

SEQ ID NO: 8433 - protein, 90 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFG

SEQ ID NO: 8434 - protein, 177 aa, Homo sapiens; identical to SEQ ID NO: 8427

SEQ ID NO: 8435 - protein, 108 aa, Homo sapiens
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWL

SEQ ID NO: 8436 - protein, 270 aa, Homo sapiens; identical to SEQ ID NO: 8428

SEQ ID NO: 8437 - protein, 177 aa, Homo sapiens; identical to SEQ ID NO: 8427

SEQ ID NO: 8438 - protein, 177 aa, Homo sapiens; identical to SEQ ID NO: 8427

SEQ ID NO: 8439 - protein, 389 aa, Homo sapiens
MAEPDPSHPLETQAGKVQEAQDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 8440 - protein, 271 aa, Homo sapiens
MAEPDPSHPLETQAGKVQEAQDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQGRGLAG

SEQ ID NO: 8441 - protein, 130 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQ

SEQ ID NO: 8442 - protein, 352 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 8443 - protein, 169 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPL

SEQ ID NO: 8444 - protein, 237 aa, Homo sapiens
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLIS

SEQ ID NO: 8445 - protein, 78 aa, Homo sapiens
MDFLRNLFSQTLSLGSQKERLLDELTLEGVARYMQSERCRRVICLVGAGISTSAGIPDFRSPSTGLYDNLEKYHLPYP

SEQ ID NO: 8446 - protein, 73 aa, Homo sapiens
MDFLRNLFSQTLSLGSQKERLLDELTLEGVARYMQSERCRRVICLVGAGISTSAGIPDFRSPSTGLYDNLEKY

SEQ ID NO: 8447 - protein, 389 aa, Homo sapiens
MSDEAEDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQGGGGPQPQHFSFPQEVPATCQGRGQDNREGETPVTAASPRRDAELLRDS

SEQ ID NO: 8448 - protein, 408 aa, Homo sapiens
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKEALKKIIEDQQESLNKWKSKGRRFKGKGKGNKAAQPGSGKGKVQFQGKKTKFASDDEHDEHDENGATGPVKRAREETDKEEPASKQQKTENGAGDQ

SEQ ID NO: 8449 - protein, 361 aa, Homo sapiens
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILFKDDYFAKKNEERKQNKVEAKLRAKQEQEAKQKLEEDAEMKSLEEKIGCLLKFSGDLDDQTCREDLHILFSNHGEIKWIDFVRGAKEGIILFKEKAKEALGKAKDANNGNLQLRNKEVTWEVLEGEVEKEALKKIIEDQQESLNKWKSKGPVKRAREETDKEEPASKQQKTENGAGDQ

SEQ ID NO: 8450 - protein, 408 aa, Homo sapiens; identical to SEQ ID NO: 8448

SEQ ID NO: 8451 - protein, 134 aa, Homo sapiens
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYISHPVAHVGVQWCDHGPLQS

SEQ ID NO: 8452 - protein, 120 aa, Homo sapiens
MIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETP

SEQ ID NO: 8453 - protein, 184 aa, Homo sapiens
MAENGDNEKMAALEAKICHQIEYYFGDFNLPRDKFLKEQIKLDEGWVPLEIMIKFNRLNRLTTDFNVIVEALSKSKAELMEISEDKTKIRRSPSKPLPEVTDEYKNDVKNRSVYIKGFPTDATLDDIKEWLEDKGQVLNIQMRRTLHKAFKGSIFVVFDSIESAKKFVETPGQKYKETDLLILF

SEQ ID NO: 8454 - protein, 83 aa, Homo sapiens
MRRTLHKAFKGSIFVVFDSIESAKKFVETPGQKYKETDLLILFKDDYFAKKNEERKQNKVEAKLRAKQEQEAKQKLEEDAEMK

SEQ ID NO: 8455 - protein, 1834 aa, Homo sapiens
MKLSVNEAQLGFYLGSLSHLSACPGIDPRSSEDQPESLKTGQMMDESDEDFKELCASFFQRVKKHGIKEVSGERKTQKAASNGTQIRSKLKRTKQTATKTKTLQGPAEKKPPSGSQAPRTKKQRVTKWQASEPAHSVNGEGGVLASAPDPPVLRETAQNTQTGNQQEPSPNLSREKTRENVPNSDSQPPPSCLTTAVPSPSKPRTAQLVLQRMQQFKRADPERLRHASEECSLEAAREENVPKDPQEEMMAGNVYGLGPPAPESDAAVALTLQQEFARVGASAHDDSLEEKGLFFCQICQKNLSAMNVTRREQHVNRCLDEAEKTLRPSVPQIPECPICGKPFLTLKSRTSHLKQCAVKMEVGPQLLLQAVRLQTAQPEGSSSPPMFSFSDHSRGLKRRGPTSKKEPRKRRKVDEAPSEDLLVAMALSRSEMEPGAAVPALRLESAFSERIRPEAENKSRKKKPPVSPPLLLVQDSETTGRQIEDRVALLLSEEVELSSTPPLPASRILKEGWERAGQCPPPPERKQSFLWEGSALTGAWAMEDFYTARLVPPLVPQRPAQGLMQEPVPPLVPPEHSELSERRSPALHGTPTAGCGSRGPSPSASQREHQALQDLVDLAREGLSASPWPGSGGLAGSEGTAGLDVVPGGLPLTGFVVPSQDKHPDRGGRTLLSLGLLVADFGAMVNNPHLSDVQFQTDSGEVLYAHKFVLYARCPLLIQYVNNEGFSAVEDGVLTQRVLLGDVSTEAARTFLHYLYTADTGLPPGLSSELSSLAHRFGVSELVHLCEQVPIATDSEGKPWEEKEAENCESRAENFQELLRSMWADEEEEAETLLKSKDHEEDQENVNEAEMEEIYEFAATQRKLLQEERAAGAGEDADWLEGGSPVSGQLLAGVQVQKQWDKVEEMEPLEPGRDEAATTWEKMGQCALPPPQGQHSGARGAEAPEQEAPEEALGHSSCSSPSRDCQAERKEGSLPHSDDAGDYEQLFSSTQGEISEPSQITSEPEEQSGAVRERGLEVSHRLAPWQASPPHPCRFLLGPPQGGSPRGSHHTSGSSLSTPRSRGGTSQVGSPTLLSPAVPSKQKRDRSILTLSKEPGHQKGKERRSVLECRNKGVLMFPEKSPSIDLTQSNPDHSSSRSQKSSSKLNEEDEVILLLDSDEELELEQTKMKSISSDPLEEKKALEISPRSCELFSIIDVDADQEPSQSPPRSEAVLQQEDEGALPENRGSLGRRGAPWLFCDRESSPSEASTTDTSWLVPATPLASRSRDCSSQTQISSLRSGLAVQAVTQHTPRASVGNREGNEVAQKFSVIRPQTPPPQTPSSCLTPVSPGTSDGRRQGHRSPSRPHPGGHPHSSPLAPHPISGDRAHFSRRFLKHSPPGPSFLNQTPAGEVVEVGDSDDEQEVASHQANRSPPLDSDPPIPIDDCCWHMEPLSPIPIDHWNLERTGPLSTSSPSRRMNEAADSRDCRSPGLLDTTPIRGSCTTQRKLQEKSSGAGSLGNSRPSFLNSALWDVWDGEEQRPPETPPPAQMPSAGGAQKPEGLETPKGANRKKNLPPKVPITPMPQYSIMETPVLKKELDRFGVRPLPKRQMVLKLKEIFQYTHQTLDSDSEDESQSSQPLLQAPHCQTLASQTYKPSRAGVHAQQEATTGPGAHRPKGPAKTKGPRHQRKHHESITPPSRSPTKEAPPGLNDDAQIPASQESVATSVDGSDSSLSSQSSSSCEFGAAFESAGEEEGEGEVSASQAAVQAADTDEALRCYIRSKPALYQKVLLYQPFELRELQAELRQNGLRVSSRRLLDFLDTHCITFTTAATRREKLQGRRRQPRGKKKVERN

SEQ ID NO: 8456 - protein, 467 aa, Homo sapiens
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 8457 - protein, 437 aa, Homo sapiens
MSSILPFTPPVVKRLLGWKKSAGGSGGAGGGEQNGQEEKWCEKAVKSLVKKLKKTGRLDELEKAITTQNCNTKCVTIPRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 8458 - protein, 467 aa, Homo sapiens; identical to SEQ ID NO: 8456

SEQ ID NO: 8459 - protein, 425 aa, Homo sapiens
MSSILPFTPPIVKRLLGWKKGEQNGQEEKWCEKAVKSLVKKLKKTGQLDELEKAITTQNVNTKCITIPRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 8460 - protein, 381 aa, Homo sapiens
MSCLHPRQTWKGAALVHRKAWWMGRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 8461 - protein, 425 aa, Homo sapiens; identical to SEQ ID NO: 8459

SEQ ID NO: 8462 - protein, 230 aa, Homo sapiens
MNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 8463 - protein, 320 aa, Homo sapiens
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 8464 - protein, 426 aa, Homo sapiens
MFRTKRSALVRRLWRSRAPGGEDEEEGAGGGGGGGELRGEGATDSRAHGAGGGGPGRAGCCLGKAVRGAKGHHHPHPPAAGAGAAGGAEADLKALTHSVLKKLKERQLELLLQAVESRGGTRTACLLLPGRLDCRLGPGAPAGAQPAQPPSSYSLPLLLCKVFRWPDLRHSSEVKRLCCCESYGKINPELVCCNPHHLSRLCELESPPPPYSRYPMDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 8465 - protein, 211 aa, Homo sapiens
MDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 8466 - protein, 211 aa, Homo sapiens; identical to SEQ ID NO: 8465

SEQ ID NO: 8467 - protein, 89 aa, Homo sapiens
MNSQQQKQPCTPPPQPQQQQVKQPCQPPPQEPCIPKTKEPCHPKVPEPCHPKVPEPCQPKVPEPCQPKVPEPCPSTVTPAPAQQKTKQK

SEQ ID NO: 8468 - protein, 89 aa, Homo sapiens; identical to SEQ ID NO: 8467

SEQ ID NO: 8469 - protein, 1419 aa, Homo sapiens
MAEGLERVRISASELRGILATLAPQAGSRENMKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 8470 - protein, 330 aa, Homo sapiens
MRFRLCHQRGCCPHERENTCTCKMIISSLQVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 8471 - protein, 511 aa, Homo sapiens
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 8472 - protein, 1388 aa, Homo sapiens
MKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 8473 - protein, 787 aa, Homo sapiens
MAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPVPPEEQANLWLVEAEISPELQKRLGRKKKRRKRKKEVCPLAPPPELHPPAPAPSTIPRLPQLPRQKCLVAAGAWGAGDSCRQGAWTLVSNPFCPEPSPPQDPFLPSAPAPVAWAHGRRQGLGPIHSRTNLMDTELMDADSDF

SEQ ID NO: 8474 - protein, 76 aa, Homo sapiens
MSDQDSSEIHFKVKMTTHLKKLKESYCQRQGVPMNSLRFLFEGQRIADNHTPKELGMEEEDVIEVYQEQTGGHSTV

SEQ ID NO: 8475 - protein, 101 aa, Homo sapiens
MSDQEAKPSTEDLGDKKEGEYIKLKVIGQDSSEIHFKVKMTTHLKKLKESYCQRQGVPMNSLRFLFEGQRIADNHTPKELGMEEEDVIEVYQEQTGGHSTV

SEQ ID NO: 8476 - protein, 101 aa, Homo sapiens; identical to SEQ ID NO: 8475

SEQ ID NO: 8477 - protein, 62 aa, Homo sapiens
MTTHLKKLKESYCQRQGVPMNSLRFLFEGQRIADNHTPKELGMEEEDVIEVYQEQTGGHSTV

SEQ ID NO: 8478 - protein, 62 aa, Homo sapiens; identical to SEQ ID NO: 8477

SEQ ID NO: 8479 - protein, 264 aa, Homo sapiens
MPRSFLVRKPSDPNRKPNYSELQDSNPEFTFQQPYDQAHLLAAIPPPEILNPTASLPMLIWDSVLAPQAQPIAWASLRLQESPRVAELTSLSDEDSGKGSQPPSPPSPAPSSFSSTSVSSLEAEAYAAFPGLGQVPKQLAQLSEAKDLQARKAFNCKYCNKEYLSLGALKMHIRSHTLPCVCGTCGKAFSRPWLLQGHVRTHTGEKPFSCPHCSRAFADRSNLRAHLQTHSDVKKYQCQACARTFSRMSLLHKHQESGCSGCPR

SEQ ID NO: 8480 - protein, 268 aa, Homo sapiens
MPRSFLVKKHFNASKKPNYSELDTHTVIISPYLYESYSMPVIPQPEILSSGAYSPITVWTTAAPFHAQLPNGLSPLSGYSSSLGRVSPPPPSDTSSKDHSGSESPISDEEERLQSKLSDPHAIEAEKFQCNLCNKTYSTFSGLAKHKQLHCDAQSRKSFSCKYCDKEYVSLGALKMHIRTHTLPCVCKICGKAFSRPWLLQGHIRTHTGEKPFSCPHCNRAFADRSNLRAHLQTHSDVKKYQCKNCSKTFSRMSLLHKHEESGCCVAH

SEQ ID NO: 8481 - protein, 268 aa, Homo sapiens; identical to SEQ ID NO: 8480

SEQ ID NO: 8482 - protein, 292 aa, Homo sapiens
MPRSFLVKTHSSHRVPNYRRLETQREINGACSACGGLVVPLLPRDKEAPSVPGDLPQPWDRSSAVACISLPLLPRIEEALGASGLDALEVSEVDPRASRAAIVPLKDSLNHLNLPPLLVLPTRWSPTLGPDRHGAPEKLLGAERMPRAPGGFECFHCHKPYHTLAGLARHRQLHCHLQVGRVFTCKYCDKEYTSLGALKMHIRTHTLPCTCKICGKAFSRPWLLQGHVRTHTGEKPYACSHCSRAFADRSNLRAHLQTHSDAKKYRCRRCTKTFSRMSLLARHEESGCCPGP

SEQ ID NO: 8483 - protein, 465 aa, Homo sapiens
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 8484 - protein, 465 aa, Homo sapiens; identical to SEQ ID NO: 8483

SEQ ID NO: 8485 - protein, 465 aa, Homo sapiens; identical to SEQ ID NO: 8483

SEQ ID NO: 8486 - protein, 465 aa, Homo sapiens; identical to SEQ ID NO: 8483

SEQ ID NO: 8487 - protein, 489 aa, Homo sapiens
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQNEELHVASLSLWKSHLRLAADTLSSEGSSGSGPRSWFLSPTLRAALHGPVCPSEVCPS

SEQ ID NO: 8488 - protein, 591 aa, Homo sapiens
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 8489 - protein, 281 aa, Homo sapiens
MLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQALRMSRPRLGLCLPGPFPPQSAAPARAGMAASSAEDPGSERGPWRRAGTVAARGDPGGERGPWRREGTLAARGDPGGERGPWWREGTLAAKPRMQWVTRATAP

SEQ ID NO: 8490 - protein, 269 aa, Homo sapiens
  MOD_RES (1)..(1): Any amino acid
XLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQALRMSRPRLGLCLPGPFPPQSAAPARAGMAASSAEDPGSERGPWRRAGTVAARGDPGGERGPWRREGTLAARGDPGGERGPWWREGTLAAKPRMQWVTRATAP

SEQ ID NO: 8491 - protein, 182 aa, Homo sapiens
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSF

SEQ ID NO: 8492 - protein, 154 aa, Homo sapiens
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAG

SEQ ID NO: 8493 - protein, 551 aa, Homo sapiens
MRPQPAEPAPGGRGNEACSIHSEVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 8494 - protein, 61 aa, Homo sapiens
MVPSSPAVEKQVPVEPGPDPELRSWRHLVCYLCFYGFMAQIRPGESFITPYLLGPDKNFTR

SEQ ID NO: 8495 - protein, 234 aa, Homo sapiens
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVSWGRIYLPGTAPAHSFSGSRICAQQGRVSLPPSPHSLAEDNYGTQVQRTQHHGLPVDSKMT

SEQ ID NO: 8496 - protein, 458 aa, Homo sapiens
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTLNGSMPEGGD

SEQ ID NO: 8497 - protein, 434 aa, Homo sapiens
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVPMYVGEVSPTALRGALGTLHQLGIVVGIIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 8498 - protein, 175 aa, Homo sapiens
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGNPKLETTDTPLPKKFPFRPQARKVTAVQCPFCLSICPLHSLLILGPTSTATEAGKGHNV

SEQ ID NO: 8499 - protein, 492 aa, Homo sapiens
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 8500 - protein, 250 aa, Homo sapiens
MLMMNLLAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSVSLCLLAPPAKPQGGGSAIFP

SEQ ID NO: 8501 - protein, 556 aa, Homo sapiens
MPSFDEALQRVGEFGRFQRRVFLLLCLTGVTFAFLFVGVVFLGTQPDHYWCRGPSAAALAERCGWSPEEEWNRTAPASRGPEPPERRGRCQRYLLEAANDSASATSALSCADPLAAFPNRSAPLVPCRGGWRYAQAHSTIVSEFDLVCVNAWMLDLTQAILNLGFLTGAFTLGYAADRYGRIVIYLLSCLGVGVTGVVVAFAPNFPVFVIFRFLQGVFGKGTWMTCYVIVTEIVGSKQRRIVGIVIQMFFTLGIIILPGIAYFIPNWQGIQLAITLPSFLFLLYYWVVPESPRWLITRKKGDKALQILRRIAKCNGKYLSSNYSEITVTDEEVSNPSFLDLVRTPQMRKCTLILMFAWFTSAVVYQGLVMRLGIIGGNLYIDFFISGVVELPGALLILLTIERLGRRLPFAASNIVAGVACLVTAFLPEGIAWLRTTVATLGRLGITMAFEIVYLVNSELYPTTLRNFGVSLCSGLCDFGGIIAPFLLFRLAAVWLELPLIIFGILASICGGLVMLLPETKGIALPETVDDVEKLGSPHSCKCGRNKKTPVSRSHL

SEQ ID NO: 8502 - protein, 557 aa, Homo sapiens [sequence omitted]

SEQ ID NO: 8503 - protein, 338 aa, Homo sapiens
MELRSGSVGSQAVARRMDGDSRDGGGGKDATGSEDYENLPTSASVSTHMTAGAMAGILEHSVMYPVDSVKTRMQSLSPDPKAQYTSIYGALKKIMRTEGFWRPLRGVNVMIMGAGPAHAMYFACYENMKRTLNDVFHHQGNSHLANGIAGSMATLLHDAVMNPAEVVKQRLQMYNSQHRSAISCIRTVWRTEGLGAFYRSYTTQLTMNIPFQSIHFITYEFLQEQVNPHRTYNPQSHIISGGLAGALAAAATTPLDVCKTLLNTQENVALSLANISGRLSGMANAFRTVYQLNGLAGYFKGIQARVIYQMPSTAISWSVYEFFKYFLTKRQLENRAPY

SEQ ID NO: 8504 - protein, 755 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSEHEHHSDHDHHSHHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 8505 - protein, 433 aa, Homo sapiens
MGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVSF

SEQ ID NO: 8506 - protein, 410 aa, Homo sapiens
MGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVALVDMVPEMLHNDASDHGCSRWGYFFLQNAGMLLGFGIMLLISIFEHKIVFRINF

SEQ ID NO: 8507 - protein, 610 aa, Homo sapiens
MDTPRGIGTFVVWDYVVFAGMLVISAAIGIYYAFAGGGQQTSKDFLMGGRRMTAVPVALSLTASFMSAVTVLGTPSEVYRFGAIFSIFAFTYFFVVVISAEVFLPVFYKLGITSTYEYLELRFNKCVRLCGTVLFIVQTILYTGIVIYAPALALNQVTGFDLWGAVVATGVVCTFYCTLGGLKAVIWTDVFQVGIMVAGFASVIIQAVVMQGGISTILNDAYDGGRLNFWNFNPNPLQRHTFWTIIIGGTFTWTSIYGVNQSQVQRYISCKSRFQAKLSLYINLVGLWAILTCSVFCGLALYSRYHDCDPWTAKKVSAPDQLMPYLVLDILQDYPGLPGLFVACAYSGTLSTVSSSINALAAVTVEDLIKPYFRSLSERSLSWISQGMSVVYGALCIGMAALASLMGALLQAALSVFGMVGGPLMGLFALGILVPFANSIGALVGLMAGFAISLWVGIGAQIYPPLPERTLPLHLDIQGCNSTYNETNLMTTTEMPFTTSVFQIYNVQRTPLMDNWYSLSYLYFSTVGTLVTLLVGILVSLSTGGRKQNLDPRYILTKEDFLSNFDIFKKKKHVLSYKSHPVEDGGTDNPAFNHIELNSDQSGKSNGTRL

SEQ ID NO: 8508 - protein, 356 aa, Homo sapiens
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVDNSKSGEEGSCLDMIFRNNKNRKK

SEQ ID NO: 8509 - protein, 369 aa, Homo sapiens
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 8510 - protein, 1104 aa, Homo sapiens
MQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPNTVNTSACFWCFQYHRCLQCI

SEQ ID NO: 8511 - protein, 1318 aa, Homo sapiens
MQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 8512 - protein, 1333 aa, Homo sapiens [sequence omitted]

SEQ ID NO: 8513 - protein, 1333 aa, Homo sapiens [sequence omitted]

SEQ ID NO: 8514 - protein, 314 aa, Homo sapiens
MLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKFPFGDLSRLRDSV

SEQ ID NO: 8515 - protein, 1050 aa, Homo sapiens
MTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 8516 - protein, 785 aa, Homo sapiens
MSDQDHSMDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 8517 - protein, 778 aa, Homo sapiens
MDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 8518 - protein, 470 aa, Homo sapiens
MSAQVLGFLRSWTPLPLAAPRGPAAAGNDAGAPAATAPGGEGEPHSRPCDARLGSTDKELKAGAAATGSAPTAPGTPWQREPRVEVMDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 8519 - protein, 384 aa, Homo sapiens
MDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 8520 - protein, 383 aa, Homo sapiens
EPTGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 8521 - protein, 384 aa, Homo sapiens; identical to SEQ ID NO: 8519

SEQ ID NO: 8522 - protein, 398 aa, Homo sapiens
MDPVVGCGRGLFGFVFSAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 8523 - protein, 384 aa, Homo sapiens; identical to SEQ ID NO: 8519

SEQ ID NO: 8524 - protein, 654 aa, Homo sapiens
MNGHLEAEEQQDQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 8525 - protein, 616 aa, Homo sapiens
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGPSWGDRDPYISHSAKPTVSQVNQPACGMLTPSSWTFLPACFPAVSRAPRTLPGMGGTQALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 8526 - protein, 627 aa, Homo sapiens
MNGHLEAEEQQDQRPDQELTGSWGHGPRSTLVRAKAMAPPPPPLAASTPLLHGEFGSYPARGPRFALTLTSQALHIQRLRPKHSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 8527 - protein, 49 aa, Homo sapiens
MNGHLEAEEQQDQRSPLTCYLGRPGCFYWSIPLGVGAWPGSGVRTTCFP

SEQ ID NO: 8528 - protein, 761 aa, Homo sapiens
MIGCLHARVSGPLWDAGLCPASSRSAHTCLSLSVSDAPVSPATAPHCLLLSTAPAPPCPCHGVLNSHPFSPPFPQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIARGRTQTPALPAAPALYGRQPGAAHGLQPVCQGAALFFHNSWLWGSQDLFRIVLTEAVGG

SEQ ID NO: 8529 - protein, 654 aa, Homo sapiens; identical to SEQ ID NO: 8524

SEQ ID NO: 8530 - protein, 618 aa, Homo sapiens
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 8531 - protein, 382 aa, Homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 8532 - protein, 450 aa, Homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKETLLANSSDPSSPAWNSAAANRTIPPTPRKTKGTTQRPLCLLETSTLLPRTGSCPPTGSALYLVAGHPSVWKKISGLRLLPGRSCCKPEGGRGRIRTAWWCRVLVGRVSSCEQCTGKGGDQVPAWNIFSTPLEL

SEQ ID NO: 8533 - protein, 271 aa, Homo sapiens
MLQACKMEGFPLVPPQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 8534 - protein, 270 aa, Homo sapiens
MLQACKMEGFPLVPPPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 8535 - protein, 800 aa, Homo sapiens
MGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKLRAKLGLKPLEVNAIKKEAGTKEEPVTADVINPMALRQREELREKLAAAKEKRLLNQKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 8536 - protein, 642 aa, Homo sapiens
MALRQREELREKLAAAKEKRLLNQKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 8537 - protein, 1463 aa, Homo sapiens
MKKKTVCTLNMGDKKYEDMEGEENGDNTISTGLLYSEADRCPICLNCLLEKEVGFPESCNHVFCMTCILKWAETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 8538 - protein, 1463 aa, Homo sapiens; identical to SEQ ID NO: 8537

SEQ ID NO: 8539 - protein, 1148 aa, Homo sapiens
MTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 8540 - protein, 466 aa, Homo sapiens
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 8541 - protein, 466 aa, Homo sapiens; identical to SEQ ID NO: 8540

SEQ ID NO: 8542 - protein, 286 aa, Homo sapiens
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRPSPSGPQSHSPTHWEQPVYTTLSRP

SEQ ID NO: 8543 - protein, 213 aa, Homo sapiens
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLD

SEQ ID NO: 8544 - protein, 474 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASPAPSSAPSHASSSASSHSSSSSSSGSSSSDDEFEDDLLDLNPSSNFESMSLGSFSSSSALDRDLDFNFEPGSGSHFEFPDYCTPEVSEMISGDWLESSISNLVFTY

SEQ ID NO: 8545 - protein, 474 aa, Homo sapiens; identical to SEQ ID NO: 8544

SEQ ID NO: 8546 - protein, 1105 aa, Homo sapiens
MLEPSSVLHANVNQAPLWCLVLRWCRECKDTVCGGKQKSRVNHTFQRREIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 8547 - protein, 1113 aa, Homo sapiens
MFSQVPRTPASGCYYLNSMTPEGQEMYLRFDQTTRRSPYRMSRILARHQLVTKIQQEIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 8548 - protein, 687 aa, Homo sapiens
MLEPSSVLHANVNQAPLWCLVLRWCRECKDTVCGGKQKSRVNHTFQRREIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQE

SEQ ID NO: 8549 - protein, 995 aa, Homo sapiens
MKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 8550 - protein, 149 aa, Homo sapiens
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMAAKLERLREKDKHIEEVRKNKESKDPADETEAD

SEQ ID NO: 8551 - protein, 149 aa, Homo sapiens; identical to SEQ ID NO: 8550

SEQ ID NO: 8552 - protein, 149 aa, Homo sapiens; identical to SEQ ID NO: 8550

SEQ ID NO: 8553 - protein, 174 aa, Homo sapiens
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMAAKLERLREKMYFWTHGPGAHPAQISAEQSCLHSVPALCPALGLQSALITWSDLSHHH

SEQ ID NO: 8554 - protein, 86 aa, Homo sapiens
MASSDIQVKELEKRASGQAFELILSPRSKESVPEFPLSPPKKKDLSLEEIQKKLEAAEERRKSHEAEVLKQLAEKREHEKEVLQKA

SEQ ID NO: 8555 - protein, 149 aa, Homo sapiens; identical to SEQ ID NO: 8550

SEQ ID NO: 8556 - protein, 1204 aa, Homo sapiens
MSFFNFRKIFKLGSEKKKKQYEHVKRDLNPEDFWEIIGELGDGAFGKVYKAQNKETSVLAAAKVIDTKSEEELEDYMVEIDILASCDHPNIVKLLDAFYYENNLWILIEFCAGGAVDAVMLELERPLTESQIQVVCKQTLDALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTVDSNKPIRELIAEAKAEVTEEVEDGKEEDEEEETENSLPIPASKRASSDLSIASSEEDKLSQNACILESVSEKTERSNSEDKLNSKILNEKPTTDEPEKAVEDINEHITDAQLEAMTELHDRTAVIKENEREKRPKLENLPDTEDQETVDINSVSEGKENNIMITLETNIEHNLKSEEEKDQEKQQMFENKLIKSEEIKDTILQTVDLVSQETGEKEANIQAVDSEVGLTKEDTQEKLGEDDKTQKDVISNTSDVIGTCEAADVAQKVDEDSAEDTQSNDGKEVVEVGQKLINKPMVGPEAGGTKEVPIKEIVEMNEIEEGKNKEQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQETRRQKKTLKKTRKFIVDGVEVSVTTSKIVTDSDSKTEELRFLRRQELRELRFLQKEEQRAQQQLNSKLQQQREQIFRRFEQEMMSKKRQYDQEIENLEKQQKQTIERLEQEHTNRLRDEAKRIKGEQEKELSKFQNMLKNRKKEEQEFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFAAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 8557 - protein, 1235 aa, Homo sapiens
MSFFNFRKIFKLGSEKKKKQYEHVKRDLNPEDFWEIIGELGDGAFGKVYKAQNKETSVLAAAKVIDTKSEEELEDYMVEIDILASCDHPNIVKLLDAFYYENNLWILIEFCAGGAVDAVMLELERPLTESQIQVVCKQTLDALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTVDSNKPIRELIAEAKAEVTEEVEDGKEEDEEEETENSLPIPASKRASSDLSIASSEEDKLSQNACILESVSEKTERSNSEDKLNSKILNEKPTTDEPEKAVEDINEHITDAQLEAMTELHDRTAVIKENEREKRPKLENLPDTEDQETVDINSVSEGKENNIMITLETNIEHNLKSEEEKDQEKQQMFENKLIKSEEIKDTILQTVDLVSQETGEKEANIQAVDSEVGLTKEDTQEKLGEDDKTQKDVISNTSDVIGTCEAADVAQKVDEDSAEDTQSNDGKEVVEVGQKLINKPMVGPEAGGTKEVPIKEIVEMNEIEEGKNKEQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQETRRQKKTLKKTRKFIVDGVEVSVTTSKIVTDSDSKTEELRFLRRQELRELRFLQKEEQRAQQQLNSKLQQQREQIFRRFEQEMMSKKRQYDQEIENLEKQQKQTIERLEQEHTNRLRDEAKRIKGEQEKELSKFQNMLKNRKKEVINEVEKAPKELRKELMKRRKEELAQSQHAQEQEFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFAAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 8558 - protein, 1147 aa, Homo sapiens
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 8559 - protein, 1071 aa, Homo sapiens
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRLMDVLTSESAWALPQHLGKGFPSPSGHKVPGWHGRMD

SEQ ID NO: 8560 - protein, 1177 aa, Homo sapiens
MDEPPFSEAALEQALGEPCDLDAALLTDIEGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 8561 - protein, 1155 aa, Homo sapiens
  MOD_RES (1)..(1): Any amino acid
XKIRRALTGEVGAGRGRANGLDAPRAGADRGAMDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 8562 - protein, 766 aa, Homo sapiens
MLAHLSRAAPCPLAAGAVAAVAVAVTRSLTAQSLRTARLGPATVPPSPLPAISSEPHDRAGKTLTDPTSHFIDRITEAWSHVGSHSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 8563 - protein, 893 aa, Homo sapiens
MKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 8564 - protein, 984 aa, Homo sapiens
MDCTFEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPVPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 8565 - protein, 1073 aa, Homo sapiens
MDCTFEDMLQLINNQDSDFPGLFDPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 8566 - protein, 470 aa, Homo sapiens
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKTE

SEQ ID NO: 8567 - protein, 214 aa, Homo sapiens
LMPACLPGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGDPCPGQLCTPSRLPGPCWAVP

SEQ ID NO: 8568 - protein, 248 aa, Homo sapiens [sequence omitted]

SEQ ID NO: 8569 - protein, 216 aa, Homo sapiens
MERASLIQKAKLAEQAERYEDMAAFMKGAVEKGEELSCEERNLLSVAYKNVVGGQRAAWRVLSSIEQKSNEEGSEEKGPEVREYRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADNAGEEGGEAPQEPQS

SEQ ID NO: 8570 - protein, 1233 aa, Homo sapiens
MGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEIKEKDSELNQKRPQYIKAKENTSHKIKKLEAAKKSLQNAQKHYKKRKGDMDELEKEMLSVEKARQEFEERMEEESQSQGRDLTLEENQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQEKSKLESELANFGPRINDIKRIIQSREREMKDLKEKMNQVEDEVFEEFCREIGVRNIREFEEEKVKRQNEIAKKRLEFENQKTRLGIQLDFEKNQLKEDQDKVHMWEQTVKKDENEIEKLKKEEQRHMKIIDETMAQLQDLKNQHLAKKSEVNDKNHEMEEIRKKLGGANKEMTHLQKEVTAIETKLEQKRSDRHNLLQACKMQDIKLPLSKGTMDDISQEEGSSQGEDSVSGSQRISSIYAREALIEIDYGDLCEDLKDAQAEEEIKQEMNTLQQKLNEQQSVLQRIAAPNMKAMEKLESVRDKFQETSDEFEAARKRAKKAKQAFEQIKKERFDRFNACFESVATNIDEIYKALSRNSSAQAFLGPENPEEPYLDGINYNCVAPGKRFRPMDNLSGGEKTVAALALLFAIHSYKPAPFFVLDEIDAALDNTNIGKVANYIKEQSTCNFQAIVISLKEEFYTKAESLIGVYPEQGDCVISKVLTFDLTKYPDANPNPNEQ

SEQ ID NO: 8571 - protein, 203 aa, Homo sapiens
MGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGCCGIYCHETPKRGQLYLKISRSGELAQEYDKRKKEMVKAEEDTQFNYHRKKNIAAERKEAKQEKE

SEQ ID NO: 8572 - protein, 516 aa, Homo sapiens
MGFLKLIEIENFKSYKGRQIIGPFQRFTAIIGPNGSGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQVKKYHRLKEEASKRAATLAQELEKFNRDQKADQDRLDLEERKKVETEAKIKQKLREIEENQKRIEKLEEYITTSKQSLEEQKKLEGELTEEVEMAKRRIDEINKELNQVMEQLGDARIDRQESSRQQRKAEIMESIKRLYPGSVYGRLIDLCQPTQKKYQIAVTKVLGKNMDAIIVDSEKTGRDCIQYIKEQRGEPETFLPLDYLEVKPTDEKLRELKGAKLVIDVIRYEPPHIKKALQYACGNALVCDNVEDARRIAFGGHQRHKTVALDGTLFQKSGVISGGASDLKAKARRWDEKAVDKLKEKKERLTEELKEQMKAKRKEAELRQVQSQAHGLQMRLKYSQSDLEQTKTRHLALNLQVGPGLQPCSPKAIHTFLA

SEQ ID NO: 8573 - protein, 289 aa, Homo sapiens
  MOD_RES (1)..(1): Any amino acid
XWYTPTPFYSSLEAALLNFRPSAPVFRMLEVSIPTPHRYVRGKSNLMDAISFVLGEKTSNLRVKTLRDLIHGAPVGKPAANRAFVSMVYSEEGAEDRTFARVIVGGSSEYKINNKVVQLHEYSEELEKLGILIKARNFLVFQGAVESIAMKNPKERTALFEEISRSGELAQEYDKRKKEMVKAEEDTQFNYHRKKNIAAERKEAKQEKEEADRYQRLKDEVVRAQVQLQLFKLYHNEVEIEKLNKELASKNKEIEKDKKRMDKVEDELKEKKKELGKMMREQQQIEKEI

SEQ ID NO: 8574 - protein, 664 aa, Homo sapiens
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTVKGSDWLGDQDAIHYMTEQAPAAVVELENYGMPFSRTEDGKIYQRAFGGQSLKFGKGGQAHRCCCVADRTGHSLLHTLYGRSLRYDTSYFVEYFALDLLMENGECRGVIALCIEDGSIHRIRAKNTVVATGGYGRTYFSCTSAHTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 8575 - protein, 519 aa, Homo sapiens
MSGVRGLSRLLSARRLALAKAWPTVLQTGTRGFHFTVDGNKRASAKVSDSISAQYPVVDHEFDAVVVGAGGAGLRAAFGLSEAGFNTACVTKLFPTRSHTVAAQGGINAALGNMEEDNWRWHFYDTSTGDGTAMITRAGLPCQDLEFVQFHPTGIYGAGCLITEGCRGEGGILINSQGERFMERYAPVAKDLASRDVVSRSMTLEIREGRGCGPEKDHVYLQLHHLPPEQLATRLPGISETAMIFAGVDVTKEPIPVLPTVHYNMGGIPTNYKGQVLRHVNGQDQIVPGLYACGEAACASVHGANRLGANSLLDLVVFGRACALSIEESCRPGDKVPPIKPNAGEESVMNLDKLRFADGSIRTSELRLSMQKSMQNHAAVFRVGSVLQEGCGKISKLYGDLKHLKTFDRGMVWNTDLVETLELQNLMLCALQTIYGAEARKESRGAHAREDYKVRIDEYDYSKPIQGQQKKPFEEHWRKHTLSYVDVGTGKVTLEYRPVIDKTLNEADCATVPPAIRSY

SEQ ID NO: 8576 - protein, 2214 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHVGDGSSDPEVLLNIENQRRGQELSATRQAHDLSPAAESSSTFSFSGRDSSFTEVPRSPKHAHSSSLQQAASRSPSFGDPQLSPEARPSTGKPKHEWFLQKDSEGDTPSLINWPSRVKVREKLVKEESARNSPELASESVTQRRHQPAPVHYVSFQSEHSAFDRVPSKAAGSTRQPIRGYVQPADTGHTAKLVTPETPENASECSWVASATQNVPKPPSLTVLEGDGRDSPVLHVCESKAEEEEGEGEGEEKEEDVCFTEALEQSKKTLLALEGDGLVRSPEDPSRNEDFGKPAVSTVTLEHQKELENVAQPPQAPHQPTERTGRSEMVLYIQSEPVSQDAKPTGHNREASKKRKVRTRSLSDFTGPPQLQALKYKDPASRRELELPSSKTEGPYGEISMLDTKVSVAQLRSAFLASANACRRPELKSRVERSAEGPGLPTGVERERGSRKPRRYFSPGESRKTSERFRTQPITSAERKESDRCTSHSETPTVDDEEKVDERAKLSVAAKRLLFREMEKSFDEQNVPKRRSRNTAVEQRLRRLQDRSLTQPITTEEVVIAATEPIPASCSGGTHPVMARLPSPTVARSAVQPARLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 8577 - protein, 2214 aa, Homo sapiens; identical to SEQ ID NO: 8576

SEQ ID NO: 8578 - protein, 1788 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHVGDGSSDPEVLLNIENQRRGQELSATRQAHDLSPAAESSSTFSFSGRDSSFTEVPRSPKHAHSSSLQQAASRSPSFGDPQLSPEARPRCTSHSETPTVDDEEKVDERAKLSVAAKRLLFREMEKSFDEQNVPKRRSRNTAVEQRLRRLQDRSLTQPITTEEVVIAATLQASAHQKALAKDQTNEGKELAEQGEPDSSTLSLAEKLALFNKLSQPVSKAISTRNRIDTRQRRMNARYQTQPVTLGEVEQVQSGKLIPFSPAVNTSVSTVASTVAPMYAGDLRTKPPLDHNASATDYKFSSSIENSDSPVRSILKSQAWQPLVEGSENKGMLREYGETESKRALTGRDSGMEKYGSFEEAEASYPILNRAREGDSHKESKYAVPRRGSLERANPPITHLGDEPKEFSMAKMNAQGNLDLRDRLPFEEKVEVENVMKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 8579 - protein, 1128 aa, Homo sapiens
MFAAGEIKTPTGEGLLDSPSKTMSIKERLALLKKSGEEDWRNRLSRRQEGGKAPASSLHTQEAGRSLIKKEEGGVADDSAISNLLWRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVGSRQKGEHSVRAAGKEKCVYFFWQGRHSTVSEKGTSALMTVELDEERGAQVQVLQGKEPPCFLQCFQGGMVVHSGRREEEEENVQSEWRLYCVRGEVPVEGNLLEVACHCSSLRSRTSMVVLNVNKALIYLWHGCKAQAHTKEVGRTAANKIKEQCPLEAGLHSSSKVTIHECDEGSEPLGFWDALGRRDRKAYDCMLQDPGSFNFAPRLFILSSSSGDFAATEFVYPARAPSVVSSMPFLQEDLYSAPQPALFLVDNHHEVYLWQGWWPIENKITGSARIRWASDRKSAMETVLQYCKGKNLKKPAPKSYLIHAGLEPLTFTNMFPSWEHREDIAEITEMDTEVSNQITLVEDVLAKLCKTIYPLADLLARPLPEGVDPLKLEIYLTDEDFEFALDMTRDEYNALPAWKQVNLKKAKGLF

SEQ ID NO: 8580 - protein, 766 aa, Homo sapiens
MKRKFSLRAAEFGEPTSEQTGTAAGKTIAQTTAPVSWKPQDSSEQPQEKLCKNPCAMFAAGEIKTPTGEGLLDSPSKTMSIKERLALLKKSGEEDWRNRLSRRQEGGKAPASSLHTQEAGRSLIKKRVTESRESQMTIEERKQLITVREEAWKTRGRGAANDSTQFTVAGRMVKKGLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAVLRAWRGARGREFAGSGLSL

SEQ ID NO: 8581 - protein, 585 aa, Homo sapiens
MNSSDVSSLKHPSSLASPTAITPVASPICGKTRGTTPVSKPLEDIEARPDMQLESDLKLDRLETFLRRLNNKVGGMHETVLTVTGKSVKEVMKPDDDETFAKFYRSVDYNMPRSPVEMDEDFDVIFDPYAPKLTSSVAEHKRAVRPKRRVQASKNPLKMLAAREDLLQEYTEQRLNVAFMESKRMKVEKMSSNSNFSEVTLAGLASKENFSNVSLRSVNLTEQNSNNSAVPYKRLMLLQIKGRRHVQTRLVEPRASALNSGDCFLLLSPHCCFLWVGEFANVIEKAKASELATLIQTKRELGCRATYIQTIEEGINTHTHAAKDFWKLLGGQTSYQSAGDPKEDELYEAAIIETNCIYRLMDDKLVPDDDYWGKIPKCSLLQPKEVLVFDFGSEVYVWHGKEVTLAQRKIAFQLAKHLWNGTFDYENCDINPLDPGECNPLIPRKGQGRPDWAIFGRLTEHNETILFKEKFLDWTELKRSNEKNPGELAQHKEDPRTDVKAYDVTRMVSMPQTTAGTILDGVNVGRGYGLVEGHDRRQFEITSVSVDVWHILEFDYSRLPKQSIGQFHEGDAYVVKWKFMVSTAG

SEQ ID NO: 8582 - protein, 211 aa, Homo sapiens
MVAHNQVAADNAVSTAAEPRRRPEPSSSSSSSPAAPARPRPCPAVPAPAPGDTHFRTFRSHADYRRITRASALLDACGFYWGPLSVHGAHERLRAEPVGTFLVRDSRQRNCFFALSVKMASGPTSIRVHFQAGRFHLDGSRESFDCLFELLEHYVAAPRRMLGAPLRQRRVRPLQELCRQRIVATVGRENLARIPLNPVLRDYLSSFPFQI

SEQ ID NO: 8583 - protein, 225 aa, Homo sapiens
MVTHSKFPAAGMSRPLDTSLRLKTFSSKSEYQLVVNAVRKLQESGFYWSAVTGGEANLLLSAEPAGTFLIRDSSDQRHFFTLSVKTQSGTKNLRIQCEGGSFSLQSDPRSTQPVPRFDCVLKLVHHYMPPPGAPSFPSPPTEPSSEVPEQPSAQPLPGSPPRRAYYIYSGGEKIPLVLSRPLSSNVATLQHLCRKTVNGHLDSYEKVTQLPGPIREFLDQYDAPL

SEQ ID NO: 8584 - protein, 433 aa, Homo sapiens
MAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQL

SEQ ID NO: 8585 - protein, 484 aa, Homo sapiens
MAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQILLTEEFVEKMLEDLEDLTSPEEFKLPKEYSWPEKKLKVSILPDVVFDSPLH

SEQ ID NO: 8586 - protein, 79 aa, Homo sapiens
MARSRLTATSVSQVQENGFVKKLEPKSGWMTFLEVTGKICEMLFCPEAILLTRKDTPYCETGLIFLTLTKTIANTYFYF

SEQ ID NO: 8587 - protein, 79 aa, Homo sapiens; identical to SEQ ID NO: 8586

SEQ ID NO: 8588 - protein, 414 aa, Homo sapiens
MNLQRYWGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYRGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCKKRMRKI

SEQ ID NO: 8589 - protein, 279 aa, Homo sapiens
MNLQSGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCKKRMRKI

SEQ ID NO: 8590 - protein, 412 aa, Homo sapiens
MLRYWGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYRGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCKKRMRKI

SEQ ID NO: 8591 - protein, 412 aa, Homo sapiens; identical to SEQ ID NO: 8590

SEQ ID NO: 8592 - protein, 412 aa, Homo sapiens; identical to SEQ ID NO: 8590

SEQ ID NO: 8593 - protein, 423 aa, Homo sapiens
MVGMSRLRNDRLADPLTGCSVCCKSSWNQLQDLCRLAKLSCPALGISKRNLYDFEVEYLCDYKKIREQEYYLVKWRGYPDSESTWEPRQNLKCVRILKQFHKDLERELLRRHHRSKTPRHLDPSLANYLVQKAKQRRALRRWEQELNAKRSHLGRITVENEVDLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMEYVGEIITSEEAERRGQIYDRQGATYLFDLDYVEDVYTVDAAYYGNISHFVNHSCDPNLQVYNVFIDNLDERLPRIAFFATRTIRAGEELTFDYNMQVDPVDMESTRMDSNFGLAGLPGSPKKRVRIECKCGTESCRKYLF

SEQ ID NO: 8594 - protein, 412 aa, Homo sapiens
MAENLKGCSVCCKSSWNQLQDLCRLAKLSCPALGISKRNLYDFEVEYLCDYKKIREQEYYLVKWRGYPDSESTWEPRQNLKCVRILKQFHKDLERELLRRHHRSKTPRHLDPSLANYLVQKAKQRRALRRWEQELNAKRSHLGRITVENEVDLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMEYVGEIITSEEAERRGQIYDRQGATYLFDLDYVEDVYTVDAAYYGNISHFVNHSCDPNLQVYNVFIDNLDERLPRIAFFATRTIRAGEELTFDYNMQVDPVDMESTRMDSNFGLAGLPGSPKKRVRIECKCGTESCRKYLF

SEQ ID NO: 8595 - protein, 215 aa, Homo sapiens
MAWISRLREHLDGPPRAFVYINEYRVGEGITLNQVAVGCECQDCLWAPTGGCCPGASLHKFAYNDQGQVRLRAGLPIYECNSRCRCGYDCPNRVVQKGIRYDLCIFRTDDGRGWGVRTLEKIRKNSFVMDPALLTVCLKLPAFPMGKAWETDLSVTGTLGRGCGRGEDRLQESPFPVPAPSVGCTYKPPPTFRNSFSTSRLSVVGIHGLLRRSKG

SEQ ID NO: 8596 - protein, 409 aa, Homo sapiens
MAENLKGCSVCCKSSWNQLQDLCRLAKLSCPALGISKRNLYDFEVEYVRLQEDPRTGILPGEMAWISRLREHLGATAESQVCAYPQAVPQGLRKGAAPAAPPVKDPPAPGPKLGQLPGAEGQAEAGAPSLGAGAQCQAHLGRITVENEVDLDGPPRAFVYINEYRVGEGITLNQVAVGCECQDCLWAPTGGCCPRHCTSLPTMTRARCGFEPGCPSTSATPAAAAAMTAQIVWYRRVSDMTSASSARMMGVAGASAPWRRFARTASSWSTWERSLPQRRQSGGQIYDRQGATYLFDLDYVEDVYTVDAAYYGNISHFVNHSCDPNLQVYNVFIDNLDERLPSLSLPQEPSGQARSSPLITTCKWTPWTWRAPAWTPTLAWLGSLAPLRSGSVLNASVGLSPAANTSSSP

SEQ ID NO: 8597 - protein, 184 aa, Homo sapiens
MAWISRLREHLGATAESQVCAYPQAVPQGLRKGAAPAAPPVKDPPAPGPKLGQLPGAEGQAEPGCPSTSATPAAAAAMTAQIVWYRRVSDMTSASSARMMGVAGASAPWRRFARTASSWSTWERSLPQRRQSGGARSTTVRAPPTSLTWTTWRTCTPWMPPTMATSPTLSTTVVTPTCRCTTSS

SEQ ID NO: 8598 - protein, 94 aa, Homo sapiens
MRAGFSDFQLIRDQVLFLQDQAQRLTEWLQLSGFENPVSESTTLCLREREKRIPTCVAVCVPSPGTVHTALLHPTTLSQSRSSSEAKMLIIHTA

SEQ ID NO: 8599 - protein, 197 aa, Homo sapiens [sequence omitted]

SEQ ID NO: 8600 - protein, 191 aa, Homo sapiens
MDVGSKEVLMESPPDYSAAPRGRFGIPCCPVHLKRLLIVVVVVVLIVVVIVGALLMGLHMSQKHTEMVLEMSIGAPEAQQRLALSEHLVTTATFSIGSTGLVVYDYQQLLIAYKPAPGTCCYIMKIAPESIPSLEALTRKVHNFQAKPAVPTSKLGQAEGRDAGSAPSGGDPAFLGMAVSTLCGEVPLYYI

SEQ ID NO: 8601 - protein, 385 aa, Homo sapiens
MMMMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 8602 - protein, 376 aa, Homo sapiens
MMMMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 8603 - protein, 26 aa, Homo sapiens
WRRLATVEERKKIVASSHALMTMTQL

SEQ ID NO: 8604 - protein, 2541 aa, Homo sapiens
MVALSLKISIGNVVKTMQFEPSTMVYDACRIIRERIPEAPAGPPSDFGLFLSDDDPKKGIWLEAGKALDYYMLRNGDTMEYRKKQRPLKIRMLDGTVKTIMVDDSKTVTDMLMTICARIGITNHDEYSLVRELMEEKKEEITGTLRKDKTLLRDEKKMEKLKQKLHTDDELNWLDHGRTLREQGVEEHETLLLRRKFFYSDQNVDSRDPVQLNLLYVQARDDILNGSHPVSFDKACEFAGFQCQIQFGPHNEQKHKAGFLDLKDFLPKEYVKQKGERKIFQAHKNCGQMSEIEAKVRYVKLARSLKTYGVSFFLVKEKMKGKNKLVPRLLGITKECVMRVDEKTKEVIQEWNLTNIKRWAASPKSFTLDFGDYQDGYYSVQTTEGEQIAQLIAGYIDIILKKKKSKDHFGLEGDEESTMLEDSVSPKKSTVLQQQYNRVGKVEHGSVALPAIMRSGASGPENFQVGSMPPAQQQITSGQMHRGHMPPLTSAQQALTGTINSSMQAVQAAQATLDDFDTLPPLGQDAASKAWRKNKMDESKHEIHSQVDAITAGTASVVNLTAGDPAETDYTAVGCAVTTISSNLTEMSRGVKLLAALLEDEGGSGRPLLQAAKGLAGAVSELLRSAQPASAEPRQNLLQAAGNVGQASGELLQQIGESDTDPHFQDALMQLAKAVASAAAALVLKAKSVAQRTEDSGLQTQVIAAATQCALSTSQLVACTKVVAPTISSPVCQEQLVEAGRLVAKAVEGCVSASQAATEDGQLLRGVGAAATAVTQALNELLQHVKAHATGAGPAGRYDQATDTILTVTENIFSSMGDAGEMVRQARILAQATSDLVNAIKADAEGESDLENSRKLLSAAKILADATAKMVEAAKGAAAHPDSEEQQQRLREAAEGLRMATNAAAQNAIKKKLVQRLEHAAKQAAASATQTIAAAQHAASTPKASAGPQPLLVQSCKAVAEQIPLLVQGVRGSQAQPDSPSAQLALIAASQSFLQPGGKMVAAAKASVPTIQDQASAMQLSQCAKNLGTALAELRTAAQKAQEACGPLEMDSALSVVQNLEKDLQEVKAAARDGKLKPLPGETMEKCTQDLGNSTKAVSSAIAQLLGEVAQGNENYAGIAARDVAGGLRSLAQAARGVAALTSDPAVQAIVLDTASDVLDKASSLIEEAKKAAGHPGDPESQQRLAQVAKAVTQALNRCVSCLPGQRDVDNALRAVGDASKRLLSDSLPPSTGTFQEAQSRLNEAAAGLNQAATELVQASRGTPQDLARASGRFGQDFSTFLEAGVEMAGQAPSQEDRAQVVSNLKGISMSSSKLLLAAKALSTDPAAPNLKSQLAAAARAVTDSINQLITMCTQQAPGQKECDNALRELETVRELLENPVQPINDMSYFGCLDSVMENSKVLGEAMTGISQNAKNGNLPEFGDAISTASKALCGFTEAAAQAAYLVGVSDPNSQAGQQGLVEPTQFARANQAIQMACQSLGEPGCTQAQVLSAATIVAKHTSALCNSCRLASARTTNPTAKRQFVQSAKEVANSTANLVKTIKALDGAFTEENRAQCRAATAPLLEAVDNLSAFASNPEFSSIPAQISPEGRAAMEPIVISAKTMLESAGGLIQTARALAVNPRDPPSWSVLAGHSRTVSDSIKKLITSMRDKAPGQLECETAIAALNSCLRDLDQASLAAVSQQLAPREGISQEALHTQMLTAVQEISHLIEPLANAARAEASQLGHKVSQMAQYFEPLTLAAVGAASKTLSHPQQMALLDQTKTLAESALQLLYTAKEAGGNPKQAAHTQEALEEAVQMMTEAVEDLTTTLNEAASAAGVVGGMVDSITQAINQLDEGPMGEPEGSFVDYQTTMVRTAKAIAVTVQEMVTKSNTSPEELGPLANQLTSDYGRLASEAKPAAVAAENEEIGSHIKHRVQELGHGCAALVTKAGALQCSPSDAYTKKELIECARRVSEKVSHVLAALQAGNRGTQACITAASAVSGIIADLDTTIMFATAGTLNREGTETFADHREGILKTAKVLVEDTKVLVQNAAGSQEKLAQAAQSSVATITRLADVVKLGAASLGAEDPETQVVLINAVKDVAKALGDLISATKAAAGKVGDDPAVWQLKNSAKVMVTNVTSLLKTVKAVEDEATKGTRALEATTEHIRQELAVFCSPEPPAKTSTPEDFIRMTKGITMATAKAVAAGNSCRQEDVIATANLSRRAIADMLRACKEAAYHPEVAPDVRLRALHYGRECANGYLELLDHVLLTLQKPSPELKQQLTGHSKRVAGSVTELIQAAEAMKGTEWVDPEDPTVIAENELLGAAAAIEAAAKKLEQLKPRAKPKEADESLNFEEQILEAAKSIAAATSALVKAASAAQRELVAQGKVGAIPANALDDGQWSQGLISAARMVAAATNNLCEAANAAVQGHASQEKLISSAKQVAASTAQLLVACKVKADQDSEAMKRLQAAGNAVKRASDNLVKAAQKAAAFEEQENETVVVKEKMVGGIAQIIAAQEEMLRKERELEEARKKLAQIRQQQYKFLPSELRDEH

SEQ ID NO: 8605 - protein, 2429 aa, Homo sapiens
MVALSLKISIGNVVKTMQFEPSTMVYDACRIIRERIPEAPAGPPSDFGLFLSDDDPKKGIWLEAGKALDYYMLRNGDTMEYRKKQRPLKIRMLDGTVKTIMVDDSKTVTDMLMTICARIGITNHDEYSLVRELMEEKKEEITGTLRKDKTLLRDEKKMEKLKQKLHTDDELNWLDHGRTLREQGVEEHETLLLRRKFFYSDQNVDSRDPVQLNLLYVQARDDILNGSHPVSFDKACEFAGFQCQIQFGPHNEQKHKAGFLDLKDFLPKEYVKQKGERKIFQAHKNCGQMSEIEAKVRYVKLARSLKTYGVSFFLVKEKMKGKNKLVPRLLGITKECVMRVDEKTKEVIQEWNLTNIKRWAASPKSFTLDFGDYQDGYYSVQTTEGEQIAQLIAGYIDIILKKKKSKDHFGLEGDEESTMLEDSVSPKKSTVLQQQYNRVGKVEHGSVALPAIMRSGASGPENFQVGSMPPAQQQITSGQMHRGHMPPLTSAQQALTGTINSSMQAVQAAQATLDDFDTLPPLGQDAASKAWRKNKMDESKHEIHSQVDAITAGTASVVNLTAGDPAETDYTAVGCAVTTISSNLTEMSRGVKLLAALLEDEGGSGRPLLQAAKGLAGAVSELLRSAQPASAEPRQNLLQAAGNVGQASGELLQQIGESDTDPHFQDALMQLAKAVASAAAALVLKAKSVAQRTEDSGLQTQVIAAATQCALSTSQLVACTKVVAPTISSPVCQEQLVEAGRLVAKAVEGCVSASQAATEDGQLLRGVGAAATAVTQALNELLQHVKAHATGAGPAGRYDQATDTILTVTENIFSSMGDAGEMVRQARILAQATSDLVNAIKADAEGESDLENSRKLLSAAKILADATAKMVEAAKGAAAHPDSEEQQQRLREAAEGLRMATNAAAQNAIKKKLVQRLEHAAKQAAASATQTIAAAQHAASTPKASAGPQPLLVQSCKAVAEQIPLLVQGVRGSQAQPDSPSAQLALIAASQSFLQPGGKMVAAAKASVPTIQDQASAMQLSQCAKNLGTALAELRTAAQKAQEACGPLEMDSALSVVQNLEKDLQEVKAAARDGKLKPLPGETMEKCTQDLGNSTKAVSSAIAQLLGEVAQGNENYAGIAARDVAGGLRSLAQAARGVAALTSDPAVQAIVLDTASDVLDKASSLIEEAKKAAGHPGDPESQQRLAQVAKAVTQALNRCVSCLPGQRDVDNALRAVGDASKRLLSDSLPPSTGTFQEAQSRLNEAAAGLNQAATELVQASRGTPQDLARASGRFGQDFSTFLEAGVEMAGQAPSQEDRAQVVSNLKGISMSSSKLLLAAKALSTDPAAPNLKSQLAAAARAVTDSINQLITMCTQQAPGQKECDNALRELETVRELLENPVQPINDMSYFGCLDSVMENSKVLGEAMTGISQNAKNGNLPEFGDAISTASKALCGFTEAAAQAAYLVGVSDPNSQAGQQGLVEPTQFARANQAIQMACQSLGEPGCTQAQVLSAATIVAKHTSALCNSCRLASARTTNPTAKRQFVQSAKEVANSTANLVKTIKALDGAFTEENRAQCRAATAPLLEAVDNLSAFASNPEFSSIPAQISPEGRAAMEPIVISAKTMLESAGGLIQTARALAVNPRDPPSWSVLAGHSRTVSDSIKKLITSMRDKAPGQLECETAIAALNSCLRDLDQASLAAVSQQLAPLQEISHLIEPLANAARAEASQLGHKVSQMAQYFEPLTLAAVGAASKTLSHPQQMALLDQTKTLAESALQLLYTAKEAGGNPKLDEGPMGEPEGSFVDYQTTMVRTAKAIAVTVQEMIGSHIKHRVQELGHGCAALVTKAGALQCSPSDAYTKKELIECARRVSEKVSHVLAALQAGNRGTQACITAASAVSGIIADLDTTIMFATAGTLNREGTETFADHREGILKTAKVLVEDTKVLVQNAAGSQEKLAQAAQSSVATITRLADVVKLGAASLGAEDPETQVVLINAVKDVAKALGDLISATKAAAGKVGDDPAVWQLKNSAKVMVTNVTSLLKTVKAVEDEATKGTRALEATTEHIRQELAPPAKTSTPEDFIRMTKGITMATAKAVAAGNSCRQEDVIATANLSRRAIADMLRACKEAAYHPEVAPDVRLRALHYGRECANGYLELLDHVLLTLQKPSPELKQQLTGHSKRVAGSVTELIQAAEAMKGTEWVDPEDPTVIAENELLGAAAAIEAAAKKLEQLKPRAKPKEADESLNFEEQILEAAKSIAAATSALVKAASAAQRELVAQGKVGAIPANALDDGQWSQGLISAARMVAAATNNLCEAANAAVQGHASQEKLISSAKQVAASTAQLLVACKVKADQDSEAMKRLQAAGNAVKRASDNLVKAAQKAAAFEEQENETVVVKEKMVGGIAQIIAAQEEMLRKERELEEARKKLAQIRQQQYKFLPSELRDEH

SEQ ID NO: 8606 - protein, 1327 aa, Homo sapiens
MAASRRSQHHHHHHQQQLQPAPGASAPPPPPPPPLSPGLAPGTTPASPTASGLAPFASPRHGLALPEGDGSRDPPDRPRSPDPVDGTSCCSTTSTICTVAAAPVVPAVSTSSAAGVAPNPAGSGSNNSPSSSSSPTSSSSSSPSSPGSSLAESPEAAGVSSTAPLGPGAAGPGTGVPAVSGALRELLEACRNGDVSRVKRLVDAANVNAKDMAGRKSSPLHFAAGFGRKDVVEHLLQMGANVHARDDGGLIPLHNACSFGHAEVVSLLLCQGADPNARDNWNYTPLHEAAIKGKIDVCIVLLQHGADPNIRNTDGKSALDLADPSAKAVLTGEYKKDELLEAARSGNEEKLMALLTPLNVNCHASDGRKSTPLHLAAGYNRVRIVQLLLQHGADVHAKDKGGLVPLHNACSYGHYEVTELLLKHGACVNAMDLWQFTPLHEAASKNRVEVCSLLLSHGADPTLVNCHGKSAVDMAPTPELRERLTYEFKGHSLLQAAREADLAKVKKTLALEIINFKQPQSHETALHCAVASLHPKRKQVTELLLRKGANVNEKNKDFMTPLHVAAERAHNDVMEVLHKHGAKMNALDTLGQTALHRAALAGHLQTCRLLLSYGSDPSIISLQGFTAAQMGNEAVQQILSESTPIRTSDVDYRLLEASKAGDLETVKQLCSSQNVNCRDLEGRHSTPLHFAAGYNRVSVVEYLLHHGADVHAKDKGGLVPLHNACSYGHYEVAELLVRHGASVNVADLWKFTPLHEAAAKGKYEICKLLLKHGADPTKKNRDGNTPLDLVKEGDTDIQDLLRGDAALLDAAKKGCLARVQKLCTPENINCRDTQGRNSTPLHLAAGYNNLEVAEYLLEHGADVNAQDKGGLIPLHNAASYGHVDIAALLIKYNTCVNATDKWAFTPLHEAAQKGRTQLCALLLAHGADPTMKNQEGQTPLDLATADDIRALLIDAMPPEALPTCFKPQATVVSASLISPASTPSCLSAASSIDNLTGPLAELAVGGASNAGDGAAGTERKEGEVAGLDMNISQFLKSLGLEHLRDIFETEQITLDVLADMGHEELKEIGINAYGHRHKLIKGVERLLGGQQGTNPYLTFHCVNQGTILLDLAPEDKEYQSVEEEMQSTIREHRDGGNAGGIFNRYNVIRIQKVVNKKLRERFCHRQKEVSEENHNHHNERMLFHGSPFINAIIHKGFDERHAYIGGMFGAGIYFAENSSKSNQYVYGIGGGTGCPTHKDRSCYICHRQMLFCRVTLGKSFLQFSTMKMAHAPPGHHSVIGRPSVNGLAYAEYVIYRGEQAYPEYLITYQIMKPEAPSQTATAAEQKT

SEQ ID NO: 8607 - protein, 1166 aa, Homo sapiens
MSGRRCAGGGAACASAAAEAVEPAARELFEACRNGDVERVKRLVTPEKVNSRDTAGRKSTPLHFAAGFGRKDVVEYLLQNGANVQARDDGGLIPLHNACSFGHAEVVNLLLRHGADPNARDNWNYTPLHEAAIKGKIDVCIVLLQHGAEPTIRNTDGRTALDLADPSAKAVLTGEYKKDELLESARSGNEEKMMALLTPLNVNCHASDGRKSTPLHLAAGYNRVKIVQLLLQHGADVHAKDKGDLVPLHNACSYGHYEVTELLVKHGACVNAMDLWQFTPLHEAASKNRVEVCSLLLSYGADPTLLNCHNKSAIDLAPTPQLKERLAYEFKGHSLLQAAREADVTRIKKHLSLEMVNFKHPQTHETALHCAAASPYPKRKQICELLLRKGANINEKTKEFLTPLHVASEKAHNDVVEVVVKHEAKVNALDNLGQTSLHRAAYCGHLQTCRLLLSYGCDPNIISLQGFTALQMGNENVQQLLQEGISLGNSEADRQLLEAAKAGDVETVKKLCTVQSVNCRDIEGRQSTPLHFAAGYNRVSVVEYLLQHGADVHAKDKGGLVPLHNACSYGHYEVAELLVKHGAVVNVADLWKFTPLHEAAAKGKYEICKLLLQHGADPTKKNRDGNTPLDLVKDGDTDIQDLLRGDAALLDAAKKGCLARVKKLSSPDNVNCRDTQGRHSTPLHLAAGYNNLEVAEYLLQHGADVNAQDKGGLIPLHNAASYGHVDVAALLIKYNACVNATDKWAFTPLHEAAQKGRTQLCALLLAHGADPTLKNQEGQTPLDLVSADDVSALLTAAMPPSALPSCYKPQVLNGVRSPGATADALSSGPSSPSSLSAASSLDNLSGSFSELSSVVSSSGTEGASSLEKKEVPGVDFSITQFVRNLGLEHLMDIFEREQITLDVLVEMGHKELKEIGINAYGHRHKLIKGVERLISGQQGLNPYLTLNTSGSGTILIDLSPDDKEFQSVEEEMQSTVREHRDGGHAGGIFNRYNILKIQKVCNKKLWERYTHRRKEVSEENHNHANERMLFHGSPFVNAIIHKGFDERHAYIGGMFGAGIYFAENSSKSNQYVYGIGGGTGCPVHKDRSCYICHRQLLFCRVTLGKSFLQFSAMKMAHSPPGHHSVTGRPSVNGLALAEYVIYRGEQAYPEYLITYQIMRPEGMVDG

SEQ ID NO: 8608 - protein, 712 aa, Homo sapiens
MREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRRMFPPFKVRVSGLDKKAKYILLMDIVAADDCRYKFHNSRWMVAGKADPEMPKRMYIHPDSPATGEQWMAKPVAFHKLKLTNNISDKHGFTILNSMHKYQPRFHIVRANDILKLPYSTFRTYVFPETDFIAVTAYQNDKITQLKIDNNPFAKGFRDTGNGRREKRKQLTLPSLRLYEEHCKPERDGAESDASSCDPPPAREPPTSPGAAPSPLRLHRARAEEKSCAADSDPEPERLSEERAGAPLGRSPAPDSASPTRLTEPERARERRSPERGKEPAESGGDGPFGLRSLEKERAEARRKDEGRKEAAEGKEQGLAPLVVQTDSASPLGAGHLPGLAFSSHLHGQQFFGPLGAGQPLFLHPGQFTMGPGAFSAMGMGHLLASVAGGGNGGGGGPGTAAGLDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 8609 - protein, 326 aa, Homo sapiens
MSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRRMFPPFKVRVSGLDKKAKYILLMDIVAADDCRYKFHNSRWMVAGKADPEMPKRMYIHPDSPATGEQWMAKPVAFHKLKLTNNISDKHGFTILNSMHKYQPRFHIVRANDILKLPYSTFRTYVFPETDFIAVTAYQNDKITQLKIDNNPFAKGFRDTGNGRREKRKQLTLPSLRLYEEHCKPERDGAESDASSCDPPPAREPPTSPGAAPSPLRLHRARG

SEQ ID NO: 8610 - protein, 331 aa, Homo sapiens
MTERPPSEAARSDPQLEGRDAAEASMAPPHLVLLNGVAKETSRAAAAEPPVIELGARGGPGGGPAGGGGAARDLKGRDAATAEARHRVPTTELCRPPGPAPAPAPASVTAELPGDGRMVQLSPPALAAPAAPGRALLYSLSQPLASLGSGFFGEPDAFPMFTTNNRVKRRPSPYEMEITDGPHTKVVRRIFTNSRERWRQQNVNGAFAELRKLIPTHPPDKKLSKNEILRLAMKYINFLAKLLNDQEEEGTQRAKTGKDPVVGAGGGGGGGGGGAPPDDLLQDVLSPNSSCGSSLDGAASPDSYTEEPAPKHTARSLHPAMLPAADGAGPR

SEQ ID NO: 8611 - protein, 333 aa, Homo sapiens
MTERPPSEAARSDPQLEGRDAAEASMAPPHLVLLNGVAKETSRAAAAEPPVIELGARGGPGGGPAGGGGAARDLKGRDAATAEARHRVPTTELCRPPGPAPAPAPASVTAELPGDGRMVQLSPPALAAPAAPGRALLYSLSQPLASLGSHSGFFGEPDAFPMFTTNNRVKRRPSPYEMEITDGPHTKVVRRIFTNSRERWRQQNVNGAFAELRKLIPTHPPDKKLSKNEILRLAMKYINFLAKLLNDQEEEGTQRAKTGKDPVVGAGGGGGGGGGGAPPDDLLQDVLSPNSSCGSSLDGAASPDSYTEEPAPKHTARSLHPAMLPAADGAGPR

SEQ ID NO: 8612 - protein, 331 aa, Homo sapiens; identical to SEQ ID NO: 8610

SEQ ID NO: 8613 - protein, 330 aa, Homo sapiens
MEHLGPHHLHPGHAEPISFGIDQILNSPDQGGCMGPASRLQDGEYGLGCLVGGAYTYGGGGSAAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTGHPYQNRTPPKKKKPRTSFTRLQICELEKRFHRQKYLASAERAALAKALKMTDAQVKTWFQNRRTKWRRQTAEEREAERQQANRILLQLQQEAFQKSLAQPLPADPLCVHNSSLFALQNLQPWSDDSTKITSVTSVASACE

SEQ ID NO: 8614 - protein, 257 aa, Homo sapiens
MEHLGPHHLHPGHAEPISFGIDQILNSPDQGGCMGPASRLQDGEYGLGCLVGGAYTYGGGGSAAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTGHPYQNRTPPKKKKPRTSFTRLQICELEKRFHRQKYLASAERAALAKALKMTDAQVKTWFQNRRTKWR

SEQ ID NO: 8615 - protein, 114 aa, Homo sapiens
MAECPTLGEAVTDHPDRLWAWEKFVYLDEKQHAWLPLTIEIKDRLQLRVLLRREDVVLGRPMTPTQIGPSLLPIMWQLYPDGRYRSSDSSFWRLVYHIKIDGVEDMLLELLPDD

SEQ ID NO: 8616 - protein, 114 aa, Homo sapiens; identical to SEQ ID NO: 8615

SEQ ID NO: 8617 - protein, 114 aa, Homo sapiens; identical to SEQ ID NO: 8615

SEQ ID NO: 8618 - protein, 114 aa, Homo sapiens; identical to SEQ ID NO: 8615

SEQ ID NO: 8619 - protein, 468 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVSMEKQRLTKANSDI

SEQ ID NO: 8620 - protein, 1124 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 8621 - protein, 1081 aa, Homo sapiens
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 8622 - protein, 1124 aa, Homo sapiens; identical to SEQ ID NO: 8620

SEQ ID NO: 8623 - protein, 976 aa, Homo sapiens
MDSLASLVLCGVSLLLSASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 8624 - protein, 2627 aa, Homo sapiens
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLSSLKSTVSASPLFQSLQISHMTQADLYRVNNSNCLLSEPPSWRAQHFSKGLDLSTCPIALKSISATETAQEATLGRWFDSEEKKGAETQMPSYSLSLGEEEEVEDLAVKLTSGDSESHPEPTDHVLQEKKMALLSLLCSTLVSEVNMNNTSDPTLAAIFEICRELALLEPEFILKASLYARQQLNVRNVANNILAIAAFLPACRPHLRRYFCAIVQLPSDWIQVAELYQSLAEGDKNKLVPLPACLRTAMTDKFAQFDEYQLAKYNPRKHRAKRHPRRPPRSPGMEPPFSHRCFPRYIGFLREEQRKFEKAGDTVSEKKNPPRFTLKKLVQRLHIHKPAQHVQALLGYRYPSNLQLFSRSRLPGPWDSSRAGKRMKLSRPETWERELSLRGNKASVWEELIENGKLPFMAMLRNLCNLLRVGISSRHHELILQRLQHAKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAARRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQRLMLPHGRLSLVTGQSGQGKTAFLASLVSALQAPDGAKVASLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESESSFLCASSDGILWNLAKCSPEGEWTTGNMWQKKANTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 8625 - protein, 2619 aa, Homo sapiens
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLSSLKSTVSASPLFQSLQISHMTQADLYRVNNSNCLLSEPPSWRAQHFSKGLDLSTCPIALKSISATETAQEATLGRWFDSEEKKGAETQMPSYSLSLGEEEEVEDLAVKLTSGDSESHPEPTDHVLQEKKMALLSLLCSTLVSEVNMNNTSDPTLAAIFEICRELALLEPEFILKASLYARQQLNVRNVANNILAIAAFLPACRPHLRRYFCAIVQLPSDWIQVAELYQSLAEGDKNKLVPLPACLRTAMTDKFAQFDEYQLAKYNPRKHRAKRHPRRPPRSPGMEPPFSHRCFPRYIGFLREEQRKFEKAGDTVSEKKNPPRFTLKKLVQRLHIHKPAQHVQALLGYRYPSNLQLFSRSRLPGPWDSSRAGKRMKLSRPETWERELSLRGNKASVWEELIENGKLPFMAMLRNLCNLLRVGISSRHHELILQRLQHAKSVIHSRQFPFRFLNAHDAIDALEAQLRNQALPFPSNITLMRRILTRNEKNRPRRRFLCHLSRQQLRMAMRIPVLYEQLKREKLRVHKARQWKYDGEMLNRYRQALETAVNLSVKHSLPLLPGRTVLVYLTDANADRLCPKSNPQGPPLNYALLLIGMMITRAEQVDVVLCGGDTLKTAVLKAEEGILKTAIKLQAQVQEFDENDGWSLNTFGKYLLSLAGQRVPVDRVILLGQSMDDGMINVAKQLYWQRVNSKCLFVGILLRRVQYLSTDLNPNDVTLSGCTDAILKFIAEHGASHLLEHVGQMDKIFKIPPPPGKTGVQSLRPLEEDTPSPLAPVSQQGWRSIRLFISSTFRDMHGERDLLLRSVLPALQARAAPHRISLHGIDLRWGVTEEETRRNRQLEVCLGEVENAQLFVGILGSRYGYIPPSYNLPDHPHFHWAQQYPSGRSVTEMEVMQFLNRNQRLQPSAQALIYFRDSSFLSSVPDAWKSDFVSESEEAARRISELKSYLSRQKGITCRRYPCEWGGVAAGRPYVGGLEEFGQLVLQDVWNMIQKLYLQPGALLEQPVSIPDDDLVQATFQQLQKPPSPARPRLLQDTVQRLMLPHGRLSLVTGQSGQGKTAFLASLVSALQAPDGAKVASLVFFHFSGARPDQGLALTLLRRLCTYLRGQLKEPGALPSTYRSLVWELQQRLLPKSAESLHPGQTQVLIIDGADRLVDQNGQLISDWIPKKLPRCVHLVLSVSSDAGLGETLEQSQGAHVLALGPLEASARARLVREELALYGKRLEESPFNNQMRLLLVKRESGRPLYLRLVTDHLRLFTLYEQVSERLRTLPATVPLLLQHILSTLEKEHGPDVLPQALTALEVTRSGLTVDQLHGVLSVWRTLPKGTKSWEEAVAAGNSGDPYPMGPFACLVQSLRSLLGEGPLERPGARLCLPDGPLRTAAKRCYGKRPGLEDTAHILIAAQLWKTCDADASGTFRSCPPEALGDLPYHLLQSGNRGLLSKFLTNLHVVAAHLELGLVSRLLEAHALYASSVPKEEQKLPEADVAVFRTFLRQQASILSQYPRLLPQQAANQPLDSPLCHQASLLSRRWHLQHTLRWLNKPRTMKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQAPGHIGALIWSSAHTFFVLSADEKISEWQVKLRKGSAPGNLSLHLNRILQEDLGVLTSLDWAPDGHFLILAKADLKLLCMKPGDAPSEIWSSYTENPMILSTHKEYGIFVLQPKDPGVLSFLRQKESGEFEERLNFDINLENPSRTLISITQAKPESALMGSYGTWPNAAQKENGPQVTCGRKKNTPETQTPGTDPSTCRESDASMDSDASMDSEPTPHLKTRQRRKIHSGSVTALHVLPELLVTASKDRDVKLWERPSMQLLGLFRCEGSVSCLEPWLGANSTLQLAVGDVQGNVYFLNWE

SEQ ID NO: 8626 - protein, 676 aa, Homo sapiens
MKNQQSSSLSLAVSSSPTAVAFSTNGQRAAVGTANGTVYLLDLRTWQEEKSVVSGCDGISACLFLSDDTLFLTAFDGLLELWDLQHGCRVLQTKAHQYQITGCCLSPDCRLLATVCLGGCLKLWDTVRGQLAFQHTYPKSLNCVAFHPEGQVIATGSWAGSISFFQVDGLKVTKDLGAPGASIRTLAFNVPGGVVAVGRLDSMVELWAWREGARLAAFPAHHGFVAAALFLHAGCQLLTAGEDGKVQVWSGSLGRPRGHLGSLSLSPALSVALSPDGDRVAVGYRADGIRIYKISSGSQGAQGQALDVAVSALAWLSPKVLVSGAEDGSLQGWALKECSLQSLWLLSRFQKPVLGLATSQELLASASEDFTVQLWPRQLLTRPHKAEDFPCGTELRGHEGPVSCCSFSTDGGSLATGGRDRSLLCWDVRTPKTPVLIHSFPACHRDWVTGCAWTKDNLLISCSSDGSVGLWDPESGQRLGQFLGHQSAVSAVAAVEEHVVSVSRDGTLKVWDHQGVELTSIPAHSGPISHCAAAMEPRAAGQPGSELLVVTVGLDGATRLWHPLLVCQTHTLLGHSGPVRAAAVSETSGLMLTASEDGSVRLWQVPKEADDTCIPRSSAAVTAVAWAPDGSMAVSGNQAGELILWQEAKAVATAQSSPEPNSTGGLRGADKSGLGS

SEQ ID NO: 8627 - protein, 166 aa, Homo sapiens
MEKLHGHVSAHPDILSLENRCLAMLPDLQPLEKLHQHVSTHSDILSLKNQCLATLPDLKTMEKPHGYVSAHPDILSLENQCLATLSDLKTMEKPHGHVSAHPDILSLENRCLATLSSLKSTVSASPLFQSLQISHMTQADLYRVNNSNCLLSEPPSWRAQHFSKGL

SEQ ID NO: 8628 - protein, 419 aa, Homo sapiens
MAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 8629 - protein, 439 aa, Homo sapiens
MAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKSVSDKQSAVTESSEGTVSLLRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 8630 - protein, 50 aa, Homo sapiens
IFSIIHGLSSLTACQLRTIYICQFLTRIAAGKTLDAQFENDERITPLESA

SEQ ID NO: 8631 - protein, 500 aa, Homo sapiens
MAGGGGSSDGSGRAAGRRASRSSGRARRGRHEPGLGGPAERGAGEARLEEAVNRWVLKFYFHEALRAFRGSRYGDFRQIRDIMQALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKVPKGKWNSSNGVEEKETWVEEDELFQVQAAPDEDSTTNITKKQKWTVEESEWVKAGVQKYGEGNWAAISKNYPFVNRTAVMIKDRWRTMKRLGMN

SEQ ID NO: 8632 - protein, 399 aa, Homo sapiens
MAEAMDLGKDPNGPTHSSTLFVRDDGSSMSFYVRPSPAKRRLSTLILHGGGTVCRVQEPGAVLLAQPGEALAEASGDFISTQYILDCVERNERLELEAYRLGPASAADTGSEAKPGALAEGAAEPEPQRHAGRIAFTDADDVAILTYVKENARSPSSVTGNALWKAMEKSSLTQHSWQSLKDRYLKHLRGQEHKYLLGDAPVSPSSQKLKRKAEEDPEAADSGEPQNKRTPDLPEEEYVKEEIQENEEAVKKMLVEATREFEEVVVDESPPDFEIHITMCDDDPPTPEEDSETQPDEEEEEEEEKVSQPEVGAAIKIIRQLMEKFNLDLSTVTQAFLKNSGELEATSAFLASGQRADGYPIWSRQDDIDLQKDDEDTREALVKKFGAQNVARRIEFRKK

SEQ ID NO: 8633 - protein, 4244 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTAPEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 8634 - protein, 4242 aa, Homo sapiens
MMPAQYALTSSLVLLVLLSTARAGPFSSRSNVTLPAPRPPPQPGGHTVGAGVGSPSSQLYEHTVEGGEKQVVFTHRINLPPSTGCGCPPGTEPPVLASEVQALRVRLEILEELVKGLKEQCTGGCCPASAQAGTGQTDVRTLCSLHGVFDLSRCTCSCEPGWGGPTCSDPTDAEIPPSSPPSASGSCPDDCNDQGRCVRGRCVCFPGYTGPSCGWPSCPGDCQGRGRCVQGVCVCRAGFSGPDCSQRSCPRGCSQRGRCEGGRCVCDPGYTGDDCGMRSCPRGCSQRGRCENGRCVCNPGYTGEDCGVRSCPRGCSQRGRCKDGRCVCDPGYTGEDCGTRSCPWDCGEGGRCVDGRCVCWPGYTGEDCSTRTCPRDCRGRGRCEDGECICDTGYSGDDCGVRSCPGDCNQRGRCEDGRCVCWPGYTGTDCGSRACPRDCRGRGRCENGVCVCNAGYSGEDCGVRSCPGDCRGRGRCESGRCMCWPGYTGRDCGTRACPGDCRGRGRCVDGRCVCNPGFTGEDCGSRRCPGDCRGHGLCEDGVCVCDAGYSGEDCSTRSCPGGCRGRGQCLDGRCVCEDGYSGEDCGVRQCPNDCSQHGVCQDGVCICWEGYVSEDCSIRTCPSNCHGRGRCEEGRCLCDPGYTGPTCATRMCPADCRGRGRCVQGVCLCHVGYGGEDCGQEEPPASACPGGCGPRELCRAGQCVCVEGFRGPDCAIQTCPGDCRGRGECHDGSCVCKDGYAGEDCGEEVPTIEGMRMHLLEETTVRTEWTPAPGPVDAYEIQFIPTTEGASPPFTARVPSSASAYDQRGLAPGQEYQVTVRALRGTSWGLPASKTITTMIDGPQDLRVVAVTPTTLELGWLRPQAEVDRFVVSYVSAGNQRVRLEVPPEADGTLLTDLMPGVEYVVTVTAERGRAVSYPASVRANTGSSPLGLLGTTDEPPPSGPSTTQGAQAPLLQQRPQELGELRVLGRDETGRLRVVWTAQPDTFAYFQLRMRVPEGPGAHEEVLPGDVRQALVPPPPPGTPYELSLHGVPPGGKPSDPIIYQGIMDKDEEKPGKSSGPPRLGELTVTDRTSDSLLLRWTVPEGEFDSFVIQYKDRDGQPQVVPVEGPQRSAVITSLDPGRKYKFVLYGFVGKKRHGPLVAEAKILPQSDPSPGTPPHLGNLWVTDPTPDSLHLSWTVPEGQFDTFMVQYRDRDGRPQVVPVEGPERSFVVSSLDPDHKYRFTLFGIANKKRYGPLTADGTTAPERKEEPPRPEFLEQPLLGELTVTGVTPDSLRLSWTVAQGPFDSFMVQYKDAQGQPQAVPVAGDENEVTVPGLDPDRKYKMNLYGLRGRQRVGPESVVAKTAPQEDVDETPSPTELGTEAPESPEEPLLGELTVTGSSPDSLSLFWTVPQGSFDSFTVQYKDRDGRPRAVRVGGKESEVTVGGLEPGHKYKMHLYGLHEGQRVGPVSAVGVTAPQQEETPPATESPLEPRLGELTVTDVTPNSVGLSWTVPEGQFDSFIVQYKDKDGQPQVVPVAADQREVTVYNLEPERKYKMNMYGLHDGQRMGPLSVVIVTAPLPPAPATEASKPPLEPRLGELTVTDITPDSVGLSWTVPEGEFDSFVVQYKDRDGQPQVVPVAADQREVTIPDLEPSRKYKFLLFGIQDGKRRSPVSVEAKTVARGDASPGAPPRLGELWVTDPTPDSLRLSWTVPEGQFDSFVVQFKDKDGPQVVPVEGHERSVTVTPLDAGRKYRFLLYGLLGKKRHGPLTADGTTEARSAMDDTGTKRPPKPRLGEELQVTTVTQNSVGLSWTVPEGQFDSFVVQYKDRDGQPQVVPVEGSLREVSVPGLDPAHRYKLLLYGLHHGKRVGPISAVAITAGREETETETTAPTPPAPEPHLGELTVEEATSHTLHLSWMVTEGEFDSFEIQYTDRDGQLQMVRIGGDRNDITLSGLESDHRYLVTLYGFSDGKHVGPVHVEALTVPEEEKPSEPPTATPEPPIKPRLGELTVTDATPDSLSLSWTVPEGQFDHFLVQYRNGDGQPKAVRVPGHEEGVTISGLEPDHKYKMNLYGFHGGQRMGPVSVVGVTAAEEETPSPTEPSMEAPEPAEEPLLGELTVTGSSPDSLSLSWTVPQGRFDSFTVQYKDRDGRPQVVRVGGEESEVTVGGLEPGRKYKMHLYGLHEGRRVGPVSAVGVTAPEEESPDAPLAKLRLGQMTVRDITSDSLSLSWTVPEGQFDHFLVQFKNGDGQPKAVRVPGHEDGVTISGLEPDHKYKMNLYGFHGGQRVGPVSAVGLTAPGKDEEMAPASTEPPTPEPPIKPRLEELTVTDATPDSLSLSWTVPEGQFDHFLVQYKNGDGQPKATRVPGHEDRVTISGLEPDNKYKMNLYGFHGGQRVGPVSAIGVTAAEEETPSPTEPSMEAPEPPEEPLLGELTVTGSSPDSLSLSWTVPQGRFDSFTVQYKDRDGRPQVVRVGGEESEVTVGGLEPGRKYKMHLYGLHEGRRVGPVSTVGVTAPQEDVDETPSPTEPGTEAPGPPEEPLLGELTVTGSSPDSLSLSWTVPQGRFDSFTVQYKDRDGRPQAVRVGGQESKVTVRGLEPGRKYKMHLYGLHEGRRLGPVSAVGVTEDEAETTQAVPTMTPEPPIKPRLGELTMTDATPDSLSLSWTVPEGQFDHFLVQYRNGDGQPKAVRVPGHEDGVTISGLEPDHKYKMNLYGFHGGQRVGPISVIGVTAAEEETPSPTELSTEAPEPPEEPLLGELTVTGSSPDSLSLSWTIPQGHFDSFTVQYKDRDGRPQVMRVRGEESEVTVGGLEPGRKYKMHLYGLHEGRRVGPVSTVGVTEDEAETTQAVPTTTPEPPNKPRLGELTVTDATPDSLSLSWMVPEGQFDHFLVQYRNGDGQPKVVRVPGHEDGVTISGLEPDHKYKMNLYGFHGGQRVGPISVIGVTAAEEETPAPTEPSTEAPEPPEEPLLGELTVTGSSPDSLSLSWTIPQGRFDSFTVQYKDRDGRPQVVRVRGEESEVTVGGLEPGCKYKMHLYGLHEGQRVGPVSAVGVTAPKDEAETTQAVPTMTPEPPIKPRLGELTVTDATPDSLSLSWMVPEGQFDHFLVQYRNGDGQPKAVRVPGHEDGVTISGLEPDHKYKMNLYGFHGGQRVGPVSAIGVTEEETPSPTEPSTEAPEAPEEPLLGELTVTGSSPDSLSLSWTVPQGRFDSFTVQYKDRDGQPQVVRVRGEESEVTVGGLEPGRKYKMHLYGLHEGQRVGPVSTVGITAPLPTPLPVEPRLGELAVAAVTSDSVGLSWTVAQGPFDSFLVQYRDAQGQPQAVPVSGDLRAVAVSGLDPARKYKFLLFGLQNGKRHGPVPVEARTAPDTKPSPRLGELTVTDATPDSVGLSWTVPEGEFDSFVVQYKDKDGRLQVVPVAANQREVTVQGLEPSRKYRFLLYGLSGRKRLGPISADSTTAPLEKELPPHLGELTVAEETSSSLRLSWTVAQGPFDSFVVQYRDTDGQPRAVPVAADQRTVTVEDLEPGKKYKFLLYGLLGGKRLGPVSALGMTAPEEDTPAPELAPEAPEPPEEPRLGVLTVTDTTPDSMRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 8635 - protein, 673 aa, Homo sapiens
MRLSWSVAQGPFDSFVVQYEDTNGQPQALLVDGDQSKILISGLEPSTPYRFLLYGLHEGKRLGPLSAEGTTGLAPAGQTSEESRPRLSQLSVTDVTTSSLRLNWEAPPGAFDSFLLRFGVPSPSTLEPHPRPLLQRELMVPGTRHSAVLRDLRSGTLYSLTLYGLRGPHKADSIQGTARTLSPVLESPRDLQFSEIRETSAKVNWMPPPSRADSFKVSYQLADGGEPQSVQVDGQARTQKLQGLIPGARYEVTVVSVRGFEESEPLTGFLTTVPDGPTQLRALNLTEGFAVLHWKPPQNPVDTYDVQVTAPGAPPLQAETPGSAVDYPLHDLVLHTNYTATVRGLRGPNLTSPASITFTTGLEAPRDLEAKEVTPRTALLTWTEPPVRPAGYLLSFHTPGGQNQEILLPGGITSHQLLGLFPSTSYNARLQAMWGQSLLPPVSTSFTTGGLRIPFPRDCGEEMQNGAGASRTSTIFLNGNRERPLNVFCDMETDGGGWLVFQRRMDGQTDFWRDWEDYAHGFGNISGEFWLGNEALHSLTQAGDYSMRVDLRAGDEAVFAQYDSFHVDSAAEYYRLHLEGYHGTAGDSMSYHSGSVFSARDRDPNSLLISCAVSYRGAWWYRNCHYANLNGLYGSTVDHQGVSWYHWKGFEFSVPFTEMKLRPRNFRSPAGGG

SEQ ID NO: 8636 - protein, 317 aa, Homo sapiens
MAKNPPENCEDCHILNAEAFKSKKICKSLKICGLVFGILALTLIVLFWGSKHFWPEVPKKAYDMEHTFYSNGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 8637 - protein, 451 aa, Homo sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKENCLDCYMDPLRLSLLPPRARKPVCPPSLCSSVITIGDLVLDSDEEENGQGEGKESLENYQKTKFDTLIPTLCEYLPPSGHGAIPVSSCDCRDSSRPL

SEQ ID NO: 8638 - protein, 354 aa, Homo sapiens
MATPLVAGPAALRFAAAASWQVVRGRCVEHFPRVLEFLRSLRAVAPGLVRYRHHERLCMGLKAKVVVELILQGRPWAQVLKALNHHFPESGPIVRDPKATKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKE

SEQ ID NO: 8639 - protein, 140 aa, Homo sapiens
MEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKE

SEQ ID NO: 8640 - protein, 416 aa, Homo sapiens
MATPLVAGPAALRFAAAASWQVVRGRCVEHFPRVLEFLRSLRAVAPGLVRYRHHERLCMGLKAKTKQDLRKILEAQETFYQQVKQLSEAPVDLASKLQELEQEYGEPFLAAMEKLLFEYLCQLEKALPTPQAQQLQDVLSWMQPGVSITSSLAWRQYGVDMGWLLPECSVTDSVNLAEPMEQNPPQQQRLALHNPLPKAKPGTHLPQGPSSRTHPEPLAGRHFNLAPLGRRRVQSQWASTRGGHKERPTVMLFPFRNLGSPTQVISKPESKEEHAIYTADLAMGTRAASTGKSKSPCQTLGGRALKENPVDLPATEQKENCLDCYMDPLRLSLLPPRARKPVCPPSLCSSVITIGDLVLDSDEEENGQGEGKESLENYQKTKFDTLIPTLCEYLPPSGHGAIPVSSCDCRDSSRPL

SEQ ID NO: 8641 - protein, 1165 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVGKCQKCTETHGVYPELANLSSDMGFSFFF

SEQ ID NO: 8642 - protein, 2002 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 8643 - protein, 1165 aa, Homo sapiens; identical to SEQ ID NO: 8641

SEQ ID NO: 8644 - protein, 110 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIK

SEQ ID NO: 8645 - protein, 637 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLSTSHKCTKLK

SEQ ID NO: 8646 - protein, 2002 aa, Homo sapiens; identical to SEQ ID NO: 8642

SEQ ID NO: 8647 - protein, 1194 aa, Homo sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVGLDRRVKLLGLKESSILVKKAKVLRDVLLLSGWFAEAAVKRSYCVWCGSELATPVRLQ

SEQ ID NO: 8648 - protein, 2023 aa, Homo sapiens
MIQEEQIQLEGSLVDGPEASLMEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 8649 - protein, 204 aa, Homo sapiens
MVCGGFACSKNCLCALNLLYTLVSLLLIGIAAWGIGFGLISSLRVVGVVIAVGIFLFLIALVGLIGAVKHHQVLLFFYMIILLLVFIVQFSVSCACLALNQEQQGQLLEVGWNNTASARNDIQRNLNCCGFRSVNPNDTCLASCVKSDHSCSPCAPIIGEYAGEVLRFVGGIGLFFSFTEILGVWLTYRYRNQKDPRANPSAFL

SEQ ID NO: 8650 - protein, 245 aa, Homo sapiens
MASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 8651 - protein, 227 aa, Homo sapiens
MASPSRRLQTKPVITCFKSVLLIYTFIFWITGVILLAVGIWGKVSLENYFSLLNEKATFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 8652 - protein, 222 aa, Homo sapiens
MERKGSAAGAKGNPSPPAAGEGQRPPPPLCVPGGGGGAPARGQVGAAAEPAELIRRAHEFKSQGAQCYKDKKFREAIGKYHRALLELKGLLPPPGERERDSRPASPAGALKPGRLSEEQSKTVEAIEIDCYNSLAACLLQAELVNYERVKEYCLKVLKKEGENFKALYRSGVAFYHLGDYDKALYYLKEARTQQPTDTNVIRYIQLTEMKLSRCSQREKEAM

SEQ ID NO: 8653 - protein, 85 aa, Homo sapiens
MVKQIESKTAFQEALDAAGDKLVVVDFSATWCGPCKMIKPFFHDVASECEVKCMPTFQFFKKGQKVGEFSGANKEKLEATINELV

SEQ ID NO: 8654 - protein, 105 aa, Homo sapiens
MVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 8655 - protein, 391 aa, Homo sapiens
MVMFKKIKSFEVVFNDPEKVYGSGEKVAGRVIVEVCEVTRVKAVRILACGVAKVLWMQGSQQCKQTSEYLRYEDTLLLEDQPTGENEMVIMRPGNKYEYKFGFELPQGPLGTSFKGKYGCVDYWVKAFLDRPSQPTQETKKNFEVVDLVDVNTPDLMAPVSAKKEKKVSCMFIPDGRVSVSARIDRKGFCEGDEISIHADFENTCSRIVVPKAAIVARHTYLANGQTKVLTQKLSSVRGNHIISGTCASWRGKSLRVQKIRPSILGCNILRVEYSLLIYVSVPGSKKVILDLPLVIGSRSGLSSRTSSMASRTSSEMSWVDLNIPDTPEAPPCYMDVIPEDHRLESPTTPLLDDMDGSQDSPIFMYAPEFKFMPPPTYTEVDPCILNNNVQ

SEQ ID NO: 8656 - protein, 497 aa, Homo sapiens
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 8657 - protein, 581 aa, Homo sapiens
MQQVMLTCKGVNRGHAVPAGPGRKPRPRRSSRLLAGEKHLTRSALLLCHTEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEFFSFI

SEQ ID NO: 8658 - protein, 549 aa, Homo sapiens
MSCEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 8659 - protein, 541 aa, Homo sapiens
MLSRLVLNSWAQAIIRPRPPKVLGLQVTTFSEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 8660 - protein, 612 aa, Homo sapiens
MPVDDYWLCLPASCARPFVQTVRVVQSCPHCCWFPGVLPSVPEPLRMPAMLPTGSHSAVLPPSHCSTAPPSTSQEPSSSADPKLCLSPPTSDSRQERNVQFGLAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 8661 - protein, 647 aa, Homo sapiens
MGCAEGKAVAAAAPTELQTKGKNGDGRRRSAKDHHPGKTLPENPAGFTSTATADSRALLQAYIDGHSVVIFSRSTCTRCTEVKKLFKSLCVPYFVLELDQTEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 8662 - protein, 499 aa, Homo sapiens
  MOD_RES (498)..(498): Selenocysteine
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCCG

SEQ ID NO: 8663 - protein, 499 aa, Homo sapiens; identical to SEQ ID NO: 8662
  MOD_RES (498)..(498): Selenocysteine

SEQ ID NO: 8664 - protein, 649 aa, Homo sapiens
  MOD_RES (648)..(648): Selenocysteine
MGCAEGKAVAAAAPTELQTKGKNGDGRRRSAKDHHPGKTLPENPAGFTSTATADSRALLQAYIDGHSVVIFSRSTCTRCTEVKKLFKSLCVPYFVLELDQTEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCCG

SEQ ID NO: 8665 - protein, 70 aa, Homo sapiens
MNGPEDLPKSYDYDLIIIGGGSGGLAAAKEAAQYGKKVMVLDFVTPTPLGTRWGLGGTCVNVGCIPKKLM

SEQ ID NO: 8666 - protein, 543 aa, Homo sapiens
  MOD_RES (542)..(542): Selenocysteine
MLSRLVLNSWAQAIIRPRPPKVLGLQVTTFSEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCCG

SEQ ID NO: 8667 - protein, 104 aa, Homo sapiens
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEA

SEQ ID NO: 8668 - protein, 551 aa, Homo sapiens
  MOD_RES (550)..(550): Selenocysteine
MSCEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCCG

SEQ ID NO: 8669 - protein, 568 aa, Homo sapiens
  MOD_RES (567)..(567): Selenocysteine
MPAMLPTGSHSAVLPPSHCSTAPPSTSQEPSSSADPKLCLSPPTSDSRQERNVQFGLAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCCG

SEQ ID NO: 8670 - protein, 175 aa, Homo sapiens
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKE

SEQ ID NO: 8671 - protein, 53 aa, Homo sapiens
MNGPEDLPKSYDYDLIIIGGGSGGLAAAKEAAQYGKKVMVLDFVTPTPLGTRW

SEQ ID NO: 8672 - protein, 72 aa, Homo sapiens
MNGPEDLPKSYDYDLIIIGGGSGGLAAAKEAAQYGKKVMVLDFVTPTPLGTRWGLGGTCVNVGCIPKKLMHQ

SEQ ID NO: 8673 - protein, 139 aa, Homo sapiens
MLSRLVLNSWAQAIIRPRPPKVLGLQVTTFSEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETGM

SEQ ID NO: 8674 - protein, 459 aa, Homo sapiens [sequence omitted]

SEQ ID NO: 8675 - protein, 547 aa, Homo sapiens
MEDGRALEGTLSELAAETDLPVVFVKQRKIGGHGPTLKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGC

SEQ ID NO: 8676 - protein, 314 aa, Homo sapiens
MGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 8677 - protein, 369 aa, Homo sapiens
MGPGARRQGRIVQGRPEMCFCPPPTPLPPLRILTLGTHTPTPCSSPGSAAGTYPTMGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 8678 - protein, 175 aa, Homo sapiens
MLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 8679 - protein, 314 aa, Homo sapiens; identical to SEQ ID NO: 8676

SEQ ID NO: 8680 - protein, 304 aa, Homo sapiens
MQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 8681 - protein, 175 aa, Homo sapiens; identical to SEQ ID NO: 8678

SEQ ID NO: 8682 - protein, 1170 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 8683 - protein, 94 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASL

SEQ ID NO: 8684 - protein, 166 aa, Homo sapiens
MAAGNVVLVPLVTVEMASSAQMLMSAKKCLMPASTTMESTGVRTRTPATTACPAPHASPAHSPSARVSNMPRPTNRCASPIPLCLCHRAGCYCEAISEQWTQKHFQACQRREDSLELANKTTLTSSFRNTGSRGQSTKGRAHTRDDCMKKIWRNCYMFGTKSFSGD

SEQ ID NO: 8685 - protein, 1172 aa, Homo sapiens
MVWRLVLLALWVWPSTQAGHQDKDTTFDLFSISNINRKTIGAKQFRGPDPGVPAYRFVRFDYIPPVNADDLSKITKIMRQKEGFFLTAQLKQDGKSRGTLLALEGPGLSQRQFEIVSNGPADTLDLTYWIDGTRHVVSLEDVGLADSQWKNVTVQVAGETYSLHVGCDLIDSFALDEPFYEHLQAEKSRMYVAKGSARESHFRGLLQNVHLVFENSVEDILSKKGCQQGQGAEINAISENTETLRLGPHVTTEYVGPSSERRPEVCERSCEELGNMVQELSGLHVLVNQLSENLKRVSNDNQFLWELIGGPPKTRNMSACWQDGRFFAENETWVVDSCTTCTCKKFKTICHQITCPPATCASPSFVEGECCPSCLHSVDGEEGWSPWAEWTQCSVTCGSGTQQRGRSCDVTSNTCLGPSIQTRACSLSKCDTRIRQDGGWSHWSPWSSCSVTCGVGNITRIRLCNSPVPQMGGKNCKGSGRETKACQGAPCPIDGRWSPWSPWSACTVTCAGGIRERTRVCNSPEPQYGGKACVGDVQERQMCNKRSCPVDGCLSNPCFPGAQCSSFPDGSWSCGSCPVGFLGNGTHCEDLDECALVPDICFSTSKVPRCVNTQPGFHCLPCPPRYRGNQPVGVGLEAAKTEKQVCEPENPCKDKTHNCHKHAECIYLGHFSDPMYKCECQTGYAGDGLICGEDSDLDGWPNLNLVCATNATYHCIKDNCPHLPNSGQEDFDKDGIGDACDDDDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRDI

SEQ ID NO: 8686 - protein, 430 aa, Homo sapiens
DDDNDGVTDEKDNCQLLFNPRQADYDKDEVGDRCDNCPYVHNPAQIDTDNNGEGDACSVDIDGDDVFNERDNCPYVYNTDQRDTDGDGVGDHCDNCPLVHNPDQTDVDNDLVGDQCDNNEDIDDDGHQNNQDNCPYISNANQADHDRDGQGDACDPDDDNDGVPDDRDNCRLVFNPDQEDLDGDGRGDICKDDFDNDNIPDIDDVCPENNAISETDFRNFQMVPLDPKGTTQIDPNWVIRHQGKELVQTANSDPGIAVGFDEFGSVDFSGTFYVNTDRDDDYAGFVFGYQSSSRFYVVMWKQVTQTYWEDQPTRAYGYSGVSLKVVNSTTGTGEHLRNALWHTGNTPGQVRTLWHDPRNIGWKDYTAYRWHLTHRPKTGYIRVLVHEGKQVMADSGPIYDQTYAGGRLGLFVFSQEMVYFSDLKYECRVI

SEQ ID NO: 8687 - protein, 83 aa, Homo sapiens
MVWRLVLLALWVWPSTQAGHQDKDTTFDLFSISNINRKTIGAKQFRGPDPGVPAYRFVRFDYIPPVNADDLSKITKIMRQKEG

SEQ ID NO: 8688 - protein, 482 aa, Homo sapiens
MAALMTPGTGAPPAPGDFSGEGSQGLPDPSPEPKQLPELIRMKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 8689 - protein, 482 aa, Homo sapiens; identical to SEQ ID NO: 8688

SEQ ID NO: 8690 - protein, 482 aa, Homo sapiens; identical to SEQ ID NO: 8688

SEQ ID NO: 8691 - protein, 410 aa, Homo sapiens
MEAENAGSYSLQQAQAFYTFPFQQLMAEAPNMAVVNEQQMPEEVPAPAPAQEPVQEAPKGRKRKPRTTEPKQPVEPKKPVESKKSGKSAKSKEKQEKITDTFKVKRKVDRFNGVSEAELLTKTLPDILTFNLDIVIIGINPGLMAAYKGHHYPGPGNHFWKCLFMSGLSEVQLNHMDDHTLPGKYGIGFTNMVERTTPGSKDLSSKEFREGGRILVQKLQKYQPRIAVFNGKCIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 8692 - protein, 206 aa, Homo sapiens
MITLYQGSMVLDLPTWWKGPRPAAKISPGIYEIFSKEVFGVKVKNLEFGLQPHKIPDTETLCYVMPSSSARCAQFPRAQDKVHYYIKLKDLRDQLKGIERNMDVQEVQYTFDLQLAQEDAKKMAVKEEKYDPGYEAAYGGAYGENPCSSEPCGFSSNGLIESVELRGESAFSGIPNGQWMTQSFTDQIPSFSNHCGTQEQEEESHA

SEQ ID NO: 8693 - protein, 1097 aa, Homo sapiens
MSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRMTGREFFSRFPELYPFLLKQLETVANTVDSDMGEPNRHPSMFLLLLVLERLYASPMDGTSSALSMGPFVPFIMRVLLCCPGWSAVARSQLTATSTSWVQAILLPQPPE

SEQ ID NO: 8694 - protein, 1880 aa, Homo sapiens
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 8695 - protein, 1953 aa, Homo sapiens
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRMTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 8696 - protein, 1953 aa, Homo sapiens; identical to SEQ ID NO: 8695

SEQ ID NO: 8697 - protein, 1634 aa, Homo sapiens
MSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWASQMTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 8698 - protein, 894 aa, Homo sapiens
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMGLY

SEQ ID NO: 8699 - protein, 207 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 8700 - protein, 143 aa, Homo sapiens
MTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 8701 - protein, 261 aa, Homo sapiens
MPLTSGSSTPPPWRVSADTSTGPTTAARSFSLLVRHRPRALCHTNQSLGRGLATTRGRGSDGNGPTGNGDHPNFSLSEGRAFGSLAAQPITSCLSVPAPPFSLGKLQDGLLHITTCSFVAPWNSLSLAQRRGFTKTYTVGCEECTVSAWTLTSNGRSFPGPFPKSWACFLLPLAILCPCGCSPTLRAVPDLSCYFPKPETAPLQILAAPFPCVQYRVITCPSLVPLILPCDYSVIPLPVPEPPGLFLGSPECSPRTQSAVP

SEQ ID NO: 8702 - protein, 96 aa, Homo sapiens [sequence omitted]

SEQ ID NO: 8703 - protein, 165 aa, Homo sapiens
  MOD_RES (1)..(1): Any amino acid
XPRALCHTNQSLGRGLATTRGRGSDGNGPTGNGDHPNFSLSEGRAFGSLAAQPITSCLSVPAPPFSLGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 8704 - protein, 136 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGEAPSPRPVPHQPVPGARPSNHEGARL

SEQ ID NO: 8705 - protein, 220 aa, Homo sapiens
MGAAARTLRLALGLLLLATLLRPADACSCSPVHPQQAFCNADVVIRAKAVSEKEVDSGNDIYGNPIKRIQYEIKQIKMFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 8706 - protein, 143 aa, Homo sapiens
MFKGPEKDIEFIYTAPSSAVCGVSLDVGGKKEYLIAGKAEGDGKMHITLCDFIVPWDTLSTTQKKSLNHRYQMGCECKITRCPMIPCYISSPDECLWMDWVTEKNINGHQAKFFACIKRSDGSCAWYRGAAPPKQEFLDIEDP

SEQ ID NO: 8707 - protein, 211 aa, Homo sapiens
MTPWLGLIVLLGSWSLGDWGAEACTCSPSHPQDAFCNSDIVIRAKVVGKKLVKEGPFGTLVYTIKQMKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 8708 - protein, 145 aa, Homo sapiens
MKMYRGFTKMPHVQYIHTEASESLCGLKLEVNKYQYLLTGRVYDGKMYTGLCNFVERWDQLTLSQRKGLNYRYHLGCNCKIKSCYYLPCFVTSKNECLWTDMLSNFGYPGYQSKHYACIRQKGGYCSWYRGWAPPDKSIINATDP

SEQ ID NO: 8709 - protein, 224 aa, Homo sapiens
MPGSPRPAPSWVLLLRLLALLRPPGLGEACSCAPAHPQQHICHSALVIRAKISSEKVVPASADPADTEKMLRYEIKQIKMFKGFEKVKDVQYIYTPFDSSLCGVKLEANSQKQYLLTGQVLSDGKVFIHLCNYIEPWEDLSLVQRESLNHHYHLNCGCQITTCYTVPCTISAPNECLWTDWLLERKLYGYQAQHYVCMKHVDGTCSWYRGHLPLRKEFVDIVQP

SEQ ID NO: 8710 - protein, 235 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 8711 - protein, 124 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKLSSMTSLKKKKKMPKLRFASRIRKIRKKQF

SEQ ID NO: 8712 - protein, 501 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 8713 - protein, 553 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYEVKMPACGMVTEAPAVGSRPRSPSSYDLVLHVPLTGAEACLMSVEEETELLLRSCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 8714 - protein, 422 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYEVKMPACGMVTEAPAVGSRPRSPSSYDLVLHVPLTGAEACLMSVEEETELLLRSCHEGRCPLMLTECPACKGLVRLGEKERHLEHECPERSLSCRHCRAPCCGADVKRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 8715 - protein, 121 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEY

SEQ ID NO: 8716 - protein, 172 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCG

SEQ ID NO: 8717 - protein, 193 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCG

SEQ ID NO: 8718 - protein, 500 aa, Homo sapiens
VAGRALSSGRAATVGALFAGVTALMAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 8719 - protein, 501 aa, Homo sapiens; identical to SEQ ID NO: 8712

SEQ ID NO: 8720 - protein, 543 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQKHEDTDCPCVVVSCPHKCSVQTLLRSEGTNQQIKAHEASSAVQHVNLLKEWSNSLEKKVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 8721 - protein, 543 aa, Homo sapiens; identical to SEQ ID NO: 8720

SEQ ID NO: 8722 - protein, 568 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQKHEDTDCPCVVVSCPHKCSVQTLLRSELSAHLSECVNAPSTCSFKRYGCVFQGTNQQIKAHEASSAVQHVNLLKEWSNSLEKKVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 8723 - protein, 485 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQESIVKDKVFKDNCCKREILALQIYCRNESRGCAEQLMLGHLLVHLKNDCHFEELPCVRPDCKEKVLRKDLRDHVEKACKYREATCSHCKSQVPMIALQVSLLQNESVEKNKSIQSLHNQICSFEIEIERQKEMLRNNESKILHLQRVIDSQAEKLKELDKEIRPFRQNWEEADSMKSSVESLQNRVTELESVDKSAGQVARNTGLLESQLSRHDQMLSVHDIRLADMDLRFQVLETASYNGVLIWKIRDYKRRKQEAVMGKTLSLYSQPFYTGYFGYKMCARVYLNGDGMGKGTHLSLFFVIMRGEYDALLPWPFKQKVTLMLMDQGSSRRHLGDAFKPDPNSSSFKKPTGEMNIASGCPVFVAQTVLENGTYIKDDTIFIKVIVDTSDLPDP

SEQ ID NO: 8724 - protein, 568 aa, Homo sapiens; identical to SEQ ID NO: 8722

SEQ ID NO: 8725 - protein, 94 aa, Homo sapiens
MESSKKMDSPGALQTNPPLKLHTDRSAGTPVFVPEQGGYKEKFVKTVEDKYKCEKCHLVLCSPKQTECGHRFCESCMAALLSSSSPKCTACQES

SEQ ID NO: 8726 - protein, 312 aa, Homo sapiens
MAAGQNGHEEWVGSAYLFVESSLDKVVLSDAYAHPQQKVAVYRALQAALAESGGSPDVLQMLKIHRSDPQLIVQLRFCGRQPCGRFLRAYREGALRAALQRSLAAALAQHSVPLQLELRAGAERLDALLADEERCLSCILAQQPDRLRDEELAELEDALRNLKCGSGARGGDGEVASAPLQPPVPSLSEVKPPPPPPPAQTFLFQGQPVVNRPLSLKDQQTFARSVGLKWRKVGRSLQRGCRALRDPALDSLAYEYEREGLYEQAFQLLRRFVQAEGRRATLQRLVEALEENELTSLAEDLLGLTDPNGGLA

SEQ ID NO: 8727 - protein, 274 aa, Homo sapiens
MATTVSTQRGPVYIGELPQDFLRITPTQQQRQVQLDAQAAQQLQYGGAVGTVGRLNITVVQAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 8728 - protein, 352 aa, Homo sapiens
QLSPSQAPAGAQEVARRVTVGSASHGGRRSTMATTVSTQRGPVYIGELPQDFLRITPTQQQRQVQLDAQAAQQLQYGGAVGTVGRLNITVVQAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAIPSHLVLGGLSALSCPWDVRLSFSCRSGKCSCCREQLLLPGCWRWWSAFRFHSWHFVM

SEQ ID NO: 8729 - protein, 224 aa, Homo sapiens
MATTVSTQRGPAKLAKNYGMTRMDPYCRLRLGYAVYETPTAHNGAKNPRWNKVIHCTVPPGVDSFYLEIFDERAFSMDDRIAWTHITIPESLRQGKVEDKWYSLSGRQGDDKEGMINLVMSYALLPAAMVMPPQPVVLMPTVYQQGVGYVPITGMPAVCSPGMVPVALPPAAVNAQPRCSEEDLKAIQDMFPNMDQEVIRSVLEAQRGNKDAAINSLLQMGEEP

SEQ ID NO: 8730 - protein, 255 aa, Homo sapiens
MASSTSLPAPGSRPKKPLGKMADWFRQTLLKKPKKRPNSPESTSSDASQPTSQDSPLPPSLSSVTSPSLPPTHASDSGSSRWSKDYDVCVCHSEEDLVAAQDLVSYLEGSTASLRCFLQLRDATPGGAIVSELCQALSSSHCRVLLITPGFLQDPWCKYQMLQALTEAPGAEGCTIPLLSGLSRAAYPPELRFMYYVDGRGPDGGFRQVKEAVMRSNQVLKHLLYHGTPEIGVKLETENPCRASDSHKCDKRYRE

SEQ ID NO: 8731 - protein, 235 aa, Homo sapiens
MASSTSLPAPGSRPKKPLGKMADWFRQTLLKKPKKRPNSPESTSSDASQPTSQDSPLPPSLSSVTSPSLPPTHASDSGSSRWSKDYDVCVCHSEEDLVAAQDLVSYLEGSTASLRCFLQLRDATPGGAIVSELCQALSSSHCRVLLITPGFLQDPWCKYQMLQALTEAPGAEGCTIPLLSGLSRAAYPPELRFMYYVDGRGPDGGFRQVKEAVMRCKLLQEGEGERDSATVSDLL

SEQ ID NO: 8732 - protein, 221 aa, Homo sapiens
MASSTSLPAPGSRPKKPLGKMADWFRQTLLKKPKKRPNSPESTSSDASQPTSQDSPLPPSLSSVTSPSLPPTHASDSGSSRWSKDYDVCVCHSEEDLVAAQDLVSYLEGSTASLRCFLQLRDATPGGAIVSELCQALSSSHCRVLLITPGFLQDPWCKYQMLQALTEAPGAEGCTIPLLSGLSRAAYPPELRFMYYVDGRGPDGGFRQVKEAVMRYLQTLS

SEQ ID NO: 8733 - protein, 221 aa, Homo sapiens; identical to SEQ ID NO: 8732

SEQ ID NO: 8734 - protein, 221 aa, Homo sapiens; identical to SEQ ID NO: 8732

SEQ ID NO: 8735 - protein, 839 aa, Homo sapiens
MMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 8736 - protein, 799 aa, Homo sapiens
MELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 8737 - protein, 858 aa, Homo sapiens [sequence omitted]

SEQ ID NO: 8738 - protein, 858 aa, Homo sapiens [sequence omitted]

SEQ ID NO: 8739 - protein, 21 aa, Homo sapiens
MGDHLDLLLGVVLMAGPVFGI

SEQ ID NO: 8740 - protein, 858 aa, Homo sapiens [sequence omitted]

SEQ ID NO: 8741 - protein, 1611 aa, Homo sapiens
QVSPSHPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQRLECSGTISAHCNLRLLGFSDSLASASRVAEITDMHHHIQLIFVFLIEMGFYHVGQAGLELLASLDPPSSASCVSHCTQLFVSNFIYLFLIFLRRSFTFVTQAGVQCTISPTSSSVLAQFFESFLFVAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 8742 - protein, 1554 aa, Homo sapiens
QVSPSHPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAHLYSRFLIDPFFPNMIPNMNLFQAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 8743 - protein, 1568 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQAITWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKVILFLNYMIYLYIYVFLLFLIYKVDLNIGLAYFTGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKQNCNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 8744 - protein, 1531 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIKNENTEGSPQEDGVELEGLKQRLEKKQKREPGTKTKKQTTLAFKPIKKGKKRNPWSDSESDRSSDESNFDVPPRETEPRRAATKTKFTMDLDSDEDFSDFDEKTDDEDFVPSDASPPKTKTSPKLSNKELKPQKSVVSDLEADDVKGSVPLSSSPPATHFPDETEITNPVPKKNVTVKKTAAKSQSSTSTTGAKKRAAPKGTKRDPALNSGVSQKPDPAKTKNRRKRKPSTSDDSDSNFEKIVSKAVTSKKSKGESDDFHMDFDSAVAPRAKSVRAKKPIKYLEESDEDDLF

SEQ ID NO: 8745 - protein, 1626 aa, Homo sapiens
MAKSGGCGAGAGVGGGNGALTWVTLFDQNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 8746 - protein, 1150 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLT

SEQ ID NO: 8747 - protein, 1621 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 8748 - protein, 57 aa, Homo sapiens
TLFDQNNAAKKEESETANKNDSSKKLSVERVYQKKTQLEHILLRPDTYIGSVEPLTQ

SEQ ID NO: 8749 - protein, 478 aa, Homo sapiens
MSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 8750 - protein, 478 aa, Homo sapiens; identical to SEQ ID NO: 8749

SEQ ID NO: 8751 - protein, 1001 aa, Homo sapiens
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAQTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 8752 - protein, 389 aa, Homo sapiens
  MOD_RES (1)..(1): Any amino acid
XSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNK

SEQ ID NO: 8753 - protein, 531 aa, Homo sapiens
MILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAQTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 8754 - protein, 906 aa, Homo sapiens
MNLIIICMARQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAQTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 8755 - protein, 862 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEVLDAVLPVMNKAHGGEKTVFRARFSSITDTDICNAMACLGEPDHNEALSVDARQELDLRIGCAFTRFQTKYFQGKYGDLDSSLISFGPCQTPTLGFCVERHDKIQSFKPETYWVLQAKVNTDKDRSLLLDWDRVRVFDREIAQMFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFHYFVDSIAGMDELMEVSFSPLAATGKPLSRCGKCHRFMKYIQAKPSRLHCSHCDETYTLPQNGTIKLYKELRCPLDDFELVLWSSGSRGKSYPLCPYCYNHPPFRDMKKGMGCNECTHPSCQHSLSMLGIGQCVECESGVLVLDPTSGPKWKVACNKCNVVAHCFENAHRVRVSADTCSVCEAALLDVDFNKAKSPLPGDETQHMGCVFCDPVFQELVELKHAASCHPMHRGGPGRRQGRGRGRARRPPGKPNPRRPKDKMSALAAYFV

SEQ ID NO: 8756 - protein, 862 aa, Homo sapiens; identical to SEQ ID NO: 8755

SEQ ID NO: 8757 - protein, 282 aa, Homo sapiens
MFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGGCACPGPRAGSVSSTQASSLLTKLPRQPCVPSPAPLHGLVSGNW

SEQ ID NO: 8758 - protein, 246 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEGENICFEVLDAVLPVMNKAHGGEKTVFRARFSSITDTDICNAMACLGEPDHNEALSVDARQELDLRIGCAFTRFQTKYFQGKYGDLDSSLISFGPCQTPTLGFCVERHDKIQSFKPETYWVLQAK

SEQ ID NO: 8759 - protein, 121 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKE

SEQ ID NO: 8760 - protein, 21 aa, Homo sapiens
MKTVLMVAEKPSLAQSIAKIL

SEQ ID NO: 8761 - protein, 42 aa, Homo sapiens
MKTVLMVAEKPSLAQSIAKILSRGSLSSHKGLNGACSVHEYT

SEQ ID NO: 8762 - protein, 122 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLNMVKFLQVEGRGCDYIVLWLDCDKEG

SEQ ID NO: 8763 - protein, 47 aa, Homo sapiens
MKTVLMVAEKPSLAQSIAKILSRGSLSSHKGLNGACSVHEYTGTFAG

SEQ ID NO: 8764 - protein, 132 aa, Homo sapiens
MKTVLMVAEKPSLAQSIAKILSRGSLSSHKGLNGACSVHEYTGTFAGQPVRFKMTSVCGHVMTLDFLGKYNKWDKVDPAELFSQAPTEKKEANPKLPQASVCTQAAPGVRPHPCPPAAARVADRVVPCGPVT

SEQ ID NO: 8765 - protein, 60 aa, Homo sapiens
MKTVLMVAEKPSLAQSIAKILSRGSLSSHKGLNGACSVHEYTGTFAGQPVRFKMTSVCGH

SEQ ID NO: 8766 - protein, 61 aa, Homo sapiens
MKTVLMVAEKPSLAQSIAKILSRGSLSSHKGLNGACSVHEYTGTFAGQPVRFKMTSVCGHV

SEQ ID NO: 8767 - protein, 525 aa, Homo sapiens
  MOD_RES (1)..(1): Any amino acid
XLDSSLISFGPCQTPTLGFCVERHDKIQSFKPETYWVLQAKVNTDKDRSLLLDWDRVRVFDREIAQMFLNMTKLEKEAQVEATSRKEKAKQRPLALNTVEMLRVASSSLGMGPQHAMQTAERLYTQGYISYPRTETTHYPENFDLKGSLRQQANHPYWADTVKRLLAEGINRPRKGHDAGDHPPITPMKSATEAELGGDAWRLYEYITRHFIATVSHDCKYLQSTISFRIGPELFTCSGKTVLSPGFTEVMPWQSVPLEESLPTCQRGDAFPVGEVKMLEKQTNPPDYLTEAELITLMEKHGIGTDASIPVHINNICQRNYVTVESGRRLKPTNLGIVLVHGYYKIDAELVLPTIRSAVEKQLNLIAQGKADYRQVLGHTLDVFKRKFHYFVDSIAGMDELMEVSFSPLAATGKPLSRCGKCHRFMKYIQAKPSRLHCSHCDETYTLPQNGTIKLYKELRCPLDDFELVLWSSGSRGKSYPLCPYCYNHPPFRDMKKGECSHSLLSTGSCSLFSVPTPALHQAGL

SEQ ID NO: 8768 - protein, 576 aa, Homo sapiens
MDVRFYPAAAGDPASLDFAQCLGYYGYSKFGNNNNYMNMAEANNAFFAASEQTFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSPPASKSATPSPSSSINEEDADEANRAIGEKRAAPDSGKKPKTPKKKKKKDPNEPQKPVSAYALFFRDTQAAIKGQNPNATFGEVSKIVASMWDSLGEEQKQVYKRKTEAAKKEYLKALAAYRASLVSKAAAESAEAQTIRSVQQTLASTNLTSSLLLNTPLSQHGTVSASPQTLQQSLPRSIAPKPLTMRLPMNQIVTSVTIAANMPSNIGAPLISSMGTTMVGSAPSTQVSPSVQTQQHQMQLQQQQQQQQQQMQQMQQQQLQQHQMHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQVSIF

SEQ ID NO: 8769 - protein, 571 aa, Homo sapiens
MKCQPRSGARRIEERLHYLITTYLKFGNNNNYMNMAEANNAFFAASETFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSPPASKSATPSPSSSINEEDADEANRAIGEKRAAPDSGKKPKTPKKKKKKDPNEPQKPVSAYALFFRDTQAAIKGQNPNATFGEVSKIVASMWDSLGEEQKQVYKRKTEAAKKEYLKALAAYRASLVSKAAAESAEAQTIRSVQQTLASTNLTSSLLLNTPLSQHGTVSASPQTLQQSLPRSIAPKPLTMRLPMNQIVTSVTIAANMPSNIGAPLISSMGTTMVGSAPSTQVSPSVQTQQHQMQLQQQQQQQQQQMQQMQQQQLQQHQMHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQVSIF

SEQ ID NO: 8770 - protein, 1938 aa, Homo sapiens
MQSFREQSSYHGNQQSYPQEVHGSSRLEEFSPRQAQMFQNFGGTGGSSGSSGSGSGGGRRGAAAAAAAMASETSGHQGYQGFRKEAGDFYYMAGNKDPVTTGTPQPPQRRPSGPVQSYGPPQGSSFGNQYGSEGHVGQFQAQHSGLGGVSHYQQDYTGPFSPGSAQYQQQASSQQQQQQVQQLRQQLYQSHQPLPQATGQPASSSSHLQPMQRPSTLPSSAAGYQLRVGQFGQHYQSSASSSSSSSFPSPQRFSQSGQSYDGSYNVNAGSQYEGHNVGSNAQAYGTQSNYSYQPQSMKNFEQAKIPQGTQQGQQQQQPQQQQHPSQHVMQYTNAATKLPLQSQVGQYNQPEVPVRSPMQFHQNFSPISNPSPAASVVQSPSCSSTPSPLMQTGENLQCGQGSVPMGSRNRILQLMPQLSPTPSMMPSPNSHAAGFKGFGLEGVPEKRLTDPGLSSLSALSTQVANLPNTVQHMLLSDALTPQKKTSKRPSSSKKADSCTNSEGSSQPEEQLKSPMAESLDGGCSSSSEDQGERVRQLSGQSTSSDTTYKGGASEKAGSSPAQGAQNEPPRLNASPAAREEATSPGAKDMPLSSDGNPKVNEKTVGVIVSREAMTGRVEKPGGQDKGSQEDDPAATQRPPSNGGAKETSHASLPQPEPPGGGGSKGNKNGDNNSNHNGEGNGQSGHSAAGPGFTSRTEPSKSPGSLRYSYKDSFGSAVPRNVSGFPQYPTGQEKGDFTGHGERKGRNEKFPSLLQEVLQGYHHHPDRRYSRSTQEHQGMAGSLEGTTRPNVLVSQTNELASRGLLNKSIGSLLENPHWGPWERKSSSTAPEMKQINLTDYPIPRKFEIEPQSSAHEPGGSLSERRSVICDISPLRQIVRDPGAHSLGHMSADTRIGRNDRLNPTLSQSVILPGGLVSMETKLKSQSGQIKEEDFEQSKSQASFNNKKSGDHCHPPSIKHESYRGNASPGAATHDSLSDYGPQDSRPTPMRRVPGRVGGREGMRGRSPSQYHDFAEKLKMSPGRSRGPGGDPHHMNPHMTFSERANRSSLHTPFSPNSETLASAYHANTRAHAYGDPNAGLNSQLHYKRQMYQQQPEEYKDWSSGSAQGVIAAAQHRQEGPRKSPRQQQFLDRVRSPLKNDKDGMMYGPPVGTYHDPSAQEAGRCLMSSDGLPNKGMELKHGSQKLQESCWDLSRQTSPAKSSGPPGMSSQKRYGPPHETDGHGLAEATQSSKPGSVMLRLPGQEDHSSQNPLIMRRRVRSFISPIPSKRQSQDVKNSSTEDKGRLLHSSKEGADKAFNSYAHLSHSQDIKSIPKRDSSKDLPSPDSRNCPAVTLTSPAKTKILPPRKGRGLKLEAIVQKITSPNIRRSASSNSAEAGGDTVTLDDILSLKSGPPEGGSVAVQDADIEKRKGEVASDLVSPANQELHVEKPLPRSSEEWRGSVDDKVKTETHAETVTAGKEPPGAMTSTTSQKPGSNQGRPDGSLGGTAPLIFPDSKNVPPVGILAPEANPKAEEKENDTVTISPKQEGFPPKGYFPSGKKKGRPIGSVNKQKKQQQPPPPPPQPPQIPEGSADGEPKPKKQRQRRERRKPGAQPRKRKTKQAVPIVEPQEPEIKLKYATQPLDKTDAKNKSFYPYIHVVNKCELGAVCTIINAEEEEQTKLVRGRKGQRSLTPPPSSTESKALPASSFMLQGPVVTESSVMGHLVCCLCGKWASYRNMGDLFGPFYPQDYAATLPKNPPPKRATEMQSKVKVRHKSASNGSKTDTEEEEEQQQQQKEQRSLAAHPRFKRRHRSEDCGGGPRSLSRGLPCKKAATEGSSEKTVLDSKPSVPTTSEGGPELELQIPELPLDSNEFWVHEGCILWANGIYLVCGRLYGLQEALEIAREMKCSHCQEAGATLGCYNKGCSFRYHYPCAIDADCLLHEENFSVRCPKHKVRLWR

SEQ ID NO: 8771 - protein, 1960 aa, Homo sapiens [sequence omitted]

SEQ ID NO: 8772 - protein, 179 aa, Homo sapiens
MSTGSLSDVEDLQEVEMLECDGLKMDSNKEFVTSNESTEESSNCENGSPQKGRGGLGKRRKAPTKKSPLSGVSQEGKQVQRNAANARERARMRVLSKAFSRLKTTLPWVPPDTKLSKLDTLRLASSYIAHLRQILANDKYENGYIHPVNLTWPFMVAGKPESDLKEVVTASRLCGTTAS

SEQ ID NO: 8773 - protein, 179 aa, Homo sapiens; identical to SEQ ID NO: 8772

SEQ ID NO: 8774 - protein, 654 aa, Homo sapiens
MNQPQRMAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPDEDEDDLLPPEQKAEREKERRVANNARERLRVRDINEAFKELGRMCQLHLNSEKPQTKLLILHQAVSVILNLEQQVRERNLNPKAACLKRREEEKVSGVVGDPQMVLSAPHPGLSEAHNPAGHM

SEQ ID NO: 8775 - protein, 651 aa, Homo sapiens
MNQPQRMAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSSTDEVLSLEEKDLRDRERRMANNARERVRVRDINEAFRELGRMCQMHLKSDKAQTKLLILQQAVQVILGLEQQVRERNLNPKAACLKRREEEKVSGVVGDPQMVLSAPHPGLSEAHNPAGHM

SEQ ID NO: 8776 - protein, 658 aa, Homo sapiens
MNQPQRMAPVGTDKELSDLLDFSMMFPLPVTNGKGRPASLAGAQFGGSGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTRCQPTPRHSPPSPHQDAHVHRPHAHRTHTGRPSAGPTLFPQPHCLPLAPSRRPPHSPDEDEDDLLPPEQKAEREKERRVANNARERLRVRDINEAFKELGRMCQLHLNSEKPQTKLLILHQAVSVILNLEQQVRERNLNPKAACLKRREEEKVSGVVGDPQMVLSAPHPGLSEAHNPAGHM

SEQ ID NO: 8777 - protein, 651 aa, Homo sapiens; identical to SEQ ID NO: 8775

SEQ ID NO: 8778 - protein, 157 aa, Homo sapiens
MGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLVGGSHPEDGLAGSTSLMHNHAALPSQPGTLPDLSRPPDSYS

SEQ ID NO: 8779 - protein, 671 aa, Homo sapiens
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 8780 - protein, 667 aa, Homo sapiens
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 8781 - protein, 773 aa, Homo sapiens
MFSKRLEKIAQVPLLFPFIFIILTNYSKMEGAVESQPSFFKTSQDIVTCTWVENCYSSFSRRPLEQMFCKHQSKNIISWTGMVAHTCNPSTLGGQGLCDFAKMHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 8782 - protein, 511 aa, Homo sapiens
MYCAYTIPGMGGNSLMYYYNGKAVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 8783 - protein, 647 aa, Homo sapiens
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 8784 - protein, 537 aa, Homo sapiens
MDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 8785 - protein, 643 aa, Homo sapiens
MFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 8786 - protein, 625 aa, Homo sapiens
MEEDSRDVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 8787 - protein, 600 aa, Homo sapiens
MKDIFFQFIIARVRKCYSLSCLHTLPVVPTLRKTERGSYSSYGRESNLQGCHQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITRSRSSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 8788 - protein, 410 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 8789 - protein, 236 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNL

SEQ ID NO: 8790 - protein, 159 aa, Homo sapiens [sequence omitted]

SEQ ID NO: 8791 - protein, 311 aa, Homo sapiens
MSTLPSKWKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTSDLTNGADGMLATSSNGSQYSGSRVETPVSYVGEDDEEDDDFNENDEDD

SEQ ID NO: 8792 - protein, 381 aa, Homo sapiens
MSTLPSKWKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEKTGLCDCTAGCPAPWRSVENTGQAKDIRKLLQPSVLWNCASFCWLPVRLVLFLFHDHSLIFFPFSEMAQGTVGGVFITTAGSTSNGTRFSASDLTNGADGMLATSSNGSQYSGSRVETPVSYVGEDDEEDDDFNENDEDD

SEQ ID NO: 8793 - protein, 386 aa, Homo sapiens
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSQAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 8794 - protein, 370 aa, Homo sapiens
MIISTPQRLTSSGSVLIGSPYTPAPAMVTQTHIAEATGWVPGKRSKKGDKNGKGLRHFSMKVCEKVQRKGTTSYNEVADELVSEFTNSNNHLAADSQAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 8795 - protein, 418 aa, Homo sapiens
MQPEGIIFEAENKPSPGTESAGTFILDLSATSRTIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 8796 - protein, 386 aa, Homo sapiens; identical to SEQ ID NO: 8793

SEQ ID NO: 8797 - protein, 86 aa, Homo sapiens
MTAKNVGLTSTNAEVRGFIDQNLSPTKGNISFVAFPVSNTNSPTKILPKTLGPINVNVGPQMIISTPQRLTSSGSVLIGSPYTPAP

SEQ ID NO: 8798 - protein, 46 aa, Homo sapiens
MIISTPQRLTSSGSVLIGSPYTPAPAMVTQTHIAEATGWVPGDRKR

SEQ ID NO: 8799 - protein, 385 aa, Homo sapiens
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 8800 - protein, 89 aa, Homo sapiens
MIISTPQRLTSSGSVLIGSPYTPAPAMVTQTHIAEATGWVPGDRKRARKFIDSDFSESKRSKKGDKNGKGLRHFSMKVCEKVQRKGTTS

SEQ ID NO: 8801 - protein, 446 aa, Homo sapiens
MTAKNVGLTSTNAEVRGFIDQNLSPTKGNISFVAFPVSNTNSPTKILPKTLGPINVNVGPQMIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 8802 - protein, 27 aa, Homo sapiens
MIISTPQRLTSSGSVLIGSPYTPAPAM

SEQ ID NO: 8803 - protein, 349 aa, Homo sapiens
MLDPKCDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 8804 - protein, 220 aa, Homo sapiens
MIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINT

SEQ ID NO: 8805 - protein, 386 aa, Homo sapiens; identical to SEQ ID NO: 8793

SEQ ID NO: 8806 - protein, 310 aa, Homo sapiens
MKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 8807 - protein, 444 aa, Homo sapiens
MPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 8808 - protein, 444 aa, Homo sapiens; identical to SEQ ID NO: 8807

SEQ ID NO: 8809 - protein, 461 aa, Homo sapiens
MEDLDALLSDLETTTSHMPRSGAPKERPAEPLTPPPSYGHQPQTGSGESSGASGDKDHLYSTVCKPRSPKPAAPAAPPFSSSSGVLGTGLCELDRLLQELNATQFNITDEIMSQFPSSKVASGEQKEDQSEDKKRPSLPSSPSPGLPKASATSATLELDRLMASLSDFRVQNHLPASGPTQPPVVSSTNEGSPSPPEPTGKGSLDTMLGLLQSDLSRRGVPTQAKGLCGSCNKPIAGQVVTALGRAWHPEHFVCGGCSTALGGSSFFEKDGAPFCPECYFERFSPRCGFCNQPIRHKMVTALGTHWHPEHFCCVSCGEPFGDEGFHEREGRPYCRRDFLQLFAPRCQGCQGPILDNYISALSALWHPDCFVCRECFAPFSGGSFFEHEGRPLCENHFHARRGSLCATCGLPVTGRCVSALGRRFHPDHFTCTFCLRPLTKGSFQERAGKPYCQPCFLKLFG

SEQ ID NO: 8810 - protein, 260 aa, Homo sapiens
MVWPALWELYRELGLFQGPALGLRNHLGRKLRRRKKKKAKRTTNWKIITDRPGFHDESAIYPVGYCSTRIYASMKCPDQKCLYTCQIKDGGVQPQFEIVPEDDPQNAIVSSSADACHAELLRTISTTMGKLMPNLLPAGADFFGFSHPAIHNLIQSCPGARKCINYQWVKFDVCKPGDGQLPEGLPENDAAMSFEAFQRQIFDEDQNDPLLPGSLDLPELQPAAFVSSYQPMYLTHEPLVDTHLQHLKSPSQGSPIQSSD

SEQ ID NO: 8811 - protein, 411 aa, Homo sapiens
MSLLDGLASSPRAPLQSSKARMKKLPKKSQNEKYRLKYLRLRKAAKATVFENAAICDEIARLEEKFLKAKEERRYLLKKLLQLQALTEGEVQAAAPSHSSSLPLTYGVASSVGTIQGAGPISGPSTGAEEPFGKKTKKEKKEKGKENNKLEVLKKTCKKKKMAGGARKLVQPIALDPSGRPVFPIGLGGLTVYSLGEIITDRPGFHDESAIYPVGYCSTRIYASMKCPDQKCLYTCQIKDGGVQPQFEIVPEDDPQNAIVSSSADACHAELLRTISTTMGKLMPNLLPAGADFFGFSHPAIHNLIQSCPGARKCINYQWVKFDVCKPGDGQLPEGLPENDAAMSFEAFQRQIFDEDQNDPLLPGSLDLPELQPAAFVSSYQPMYLTHEPLVDTHLQHLKSPSQGSPIQSSD

SEQ ID NO: 8812 - protein, 426 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 8813 - protein, 503 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 8814 - protein, 465 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 8815 - protein, 71 aa, Homo sapiens
MEAAVAAPRPRLLLASTSLQCFCHLCTKDNFTCVTDGLCFVSVTETTDKVIHNSMCIAEIDLIPRDRPFVC

SEQ ID NO: 8816 - protein, 434 aa, Homo sapiens
MCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 8817 - protein, 136 aa, Homo sapiens
MKDSNRCCCGQFTNQHIPPLPSATPSKNEEESKQVETQPEKWSVAKHTQSYPTDSYGVLEFQGGGYSNKAMVRKAFRHGATRITAFIGGQSPSPKLQIPGLLHGCGSIFLDISLKNQEIYLCTWLLAMRLGNWTPL

SEQ ID NO: 8818 - protein, 1625 aa, Homo sapiens
MGQKSWIEKTFCKRECIFVIPSMKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 8819 - protein, 1603 aa, Homo sapiens
IKTSKRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 8820 - protein, 1603 aa, Homo sapiens
MKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 8821 - protein, 1642 aa, Homo sapiens
MSSFKRGSLKSSTSGSQKGQKSWIEKTFCKRECIFVIPSMKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 8822 - protein, 1390 aa, Homo sapiens
MKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQ

SEQ ID NO: 8823 - protein, 1527 aa, Homo sapiens
MYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 8824 - protein, 492 aa, Homo sapiens
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 8825 - protein, 529 aa, Homo sapiens
MPPAPPGGESGCEERGAAGHIEHSRYLSLLDAVDNSKMALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 8826 - protein, 489 aa, Homo sapiens
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMR

SEQ ID NO: 8827 - protein, 79 aa, Homo sapiens
MALNSGSPPAIGPYYENHGYQPENPYPAQPTVVPTVYEVHPAQYYPSPVPQYAPRVLTQASNPVVCTQPKSPSGTVCTS

SEQ ID NO: 8828 - protein, 492 aa, Homo sapiens; identical to SEQ ID NO: 8824

SEQ ID NO: 8829 - protein, 238 aa, Homo sapiens
MYAPGGAGLPGGRRRRSPGGSALPKQPERSLASALPGALSITALCTALAEPAWLHIHGGTCSRQELGVSDVLGYVHPDLLKDFCMNPQTVLLLRVIAAFCFLGILCSLSAFLLDVFGPKHPALKITRRYAFAHILTVLQCATVIGFSYWASELILAQQQQHKKYHGSQVYVTFAVSFYLVAGAGGASILATAANLLRHYPTEEEEQALELLSEMEENEPYPAEYEVINQFQPPPAYTP

SEQ ID NO: 8830 - protein, 238 aa, Homo sapiens; identical to SEQ ID NO: 8829

SEQ ID NO: 8831 - protein, 1024 aa, Homo sapiens
MCARMAGRTTAAPRGPYGPWLCLLVALALDVVRVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSSPLELSEFLWVDFVVENSTGGGVAVTRPVTWQLEYPGQAPEAEKDKMVWEILVSERDIRALIPLAKAEELVNTAPLTGVPQHVPVRLVTVDGGGALVEVTEHVGCESANTQVLQVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 8832 - protein, 1023 aa, Homo sapiens
MCARMAGRTTAAPRGPYGPWLCLLVALALDVVRVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSPLELSEFLWVDFVVENSTGGGVAVTRPVTWQLEYPGQAPEAEKDKMVWEILVSERDIRALIPLAKAEELVNTAPLTGVPQHVPVRLVTVDGGGALVEVTEHVGCESANTQVLQVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 8833 - protein, 341 aa, Homo sapiens
MLPEQLYFLQSPPEEEPEYHPDASAQELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 8834 - protein, 380 aa, Homo sapiens
MGAAAAEAPLRLPAAPPLAFCCYTSVLLLFAFSLPGSRASNQPPGGGGGSGGDCPGGKGKSINCSELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 8835 - protein, 130 aa, Homo sapiens
MQERTGAATARRESLPQANNPEQLCKQRCINEASWTMKRVLSCVPEPTVVMAARALCMLGLVLALLSSSSAEEYVGLSANQCAVPAKDRVDCGYPHVTPKECNNRGCCFDSRIPGVPWCFKPLQEAECTF

SEQ ID NO: 8836 - protein, 94 aa, Homo sapiens
MKRVLSCVPEPTVVMAARALCMLGLVLALLSSSSAEEYVGLSANQCAVPAKDRVDCGYPHVTPKECNNRGCCFDSRIPGVPWCFKPLQEAECTF

SEQ ID NO: 8837 - protein, 498 aa, Homo sapiens
MALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKKQQEATAEQENKRYENEYERARREALERMKAEEERRQLEDKLQAEALLQQMEELKLKEVEATKLKKEQENLLKQRWELERLEEERKQMEAFRQKAELGRFLRHQYNAQLSRRTQQIQEELEADRRILQALLEKEDESQRLHLARREQVMADVAWMKQAIEEQLQLERAREAELQMLLREEAKEMWEKREAEWARERSARDRLMSEVLTGRQQQIQEKIEQNRRAQEESLKHREQLIRNLEEVRELARREKEESEKLKSARKQELEAQVAERRLQAWEADQQEEEEEEEARRVEQLSDALLQQEAETMAEQGYRPKPYGHPKIAWN

SEQ ID NO: 8838 - protein, 498 aa, Homo sapiens; identical to SEQ ID NO: 8837

SEQ ID NO: 8839 - protein, 174 aa, Homo sapiens
MALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKK

SEQ ID NO: 8840 - protein, 220 aa, Homo sapiens
MALPTLPSYWCSQQRLNQQLARQREQEARLRQQWEQNSRYFRMSDICSSKQAEWSSKTSYQRSMHAYQREKMKEEKRRSLEARREKLRQLMQEEQDLLARELEELRLSMNLQERRIREQHGKLKSAKEEQRKLIAEQLLYEHWKKNNPKLREMELDLHQKHVVNSWEMQKEEKKQQEATAEQENKRYENEYERARREALERMKAEEERRLSRTDGHKRNP

SEQ ID NO: 8841 - protein, 498 aa, Homo sapiens; identical to SEQ ID NO: 8837

SEQ ID NO: 8842 - protein, 1029 aa, Homo sapiens
MQTNEGEVSEESSSKVEQEDFVMEGHGKTPPPGEESKQEKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPVWSKSTPPAPDNGTSAWGEPNESSPGWGEMDDTGASTTGWGNTPANAPNAMKPNSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 8843 - protein, 1723 aa, Homo sapiens
MREKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASDSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 8844 - protein, 1723 aa, Homo sapiens
MREKEQEREEQLMEDKKRKKEDKKKKEATQKHSNQKTAMPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASDSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 8845 - protein, 1029 aa, Homo sapiens; identical to SEQ ID NO: 8842

SEQ ID NO: 8846 - protein, 37 aa, Homo sapiens
MQTNEGEVSEESSSKVEQEDFVMEGHGKTPPPGEESK

SEQ ID NO: 8847 - protein, 1833 aa, Homo sapiens
MREKEQEREEQLMEDKKRKKEDKKKKEATQKVTEQKTKVPEVTKPSLSQPTAASPIGSSPSPPVNGGNNAKRVAVPNGQPPSAARYMPREVPPRFRCQQDHKVLLKRGQPPPPSCMLLGGGAGPPPCTAPGANPNNAQVTGALLQSESGTAPDSTLGGAAASNYANSTWGSGASSNNGTSPNPIHIWDKVIVDGSDMEEWPCIASKDTESSSENTTDNNSASNPGSEKSTLPGSTTSNKGKGSQCQSASSGNECNLGVWKSDPKAKSVQSSNSTTENNNGLGNWRNVSGQDRIGPGSGFSNFNPNSNPSAWPALVQEGTSRKGALETDNSNSSAQVSTVGQTSREQQSKMENAGVNFVVSGREQAQIHNTDGPKNGNTNSLNLSSPNPMENKGMPFGMGLGNTSRSTDAPSQSTGDRKTGSVGSWGAARGPSGTDTVSGQSNSGNNGNNGKEREDSWKGASVQKSTGSKNDSWDNNNRSTGGSWNFGPQDSNDNKWGEGNKMTSGVSQGEWKQPTGSDELKIGEWSGPNQPNSSTGAWDNQKGHPLPENQGNAQAPCWGRSSSSTGSEVGGQSTGSNHKAGSSDSHNSGRRSYRPTHPDCQAVLQTLLSRTDLDPRVLSNTGWGQTQIKQDTVWDIEEVPRPEGKSDKGTEGWESAATQTKNSGGWGDAPSQSNQMKSGWGELSASTEWKDPKNTGGWNDYKNNNSSNWGGGRPDEKTPSSWNENPSKDQGWGGGRQPNQGWSSGKNGWGEEVDQTKNSNWESSASKPVSGWGEGGQNEIGTWGNGGNASLASKGGWEDCKRSPAWNETGRQPNSWNKQHQQQQPPQQPPPPQPEASGSWGGPPPPPPGNVRPSNSSWSSGPQPATPKDEEPSGWEEPSPQSISRKMDIDDGTSAWGDPNSYNYKNVNLWDKNSQGGPAPREPNLPTPMTSKSASVWSKSTPPAPDNGTSAWGEPNESSPGWGEMDDTGASTTGWGNTPANAPNAMKPNSKSMQDGWGESDGPVTGARHPSWEEEEDGGVWNTTGSQGSASSHNSASWGQGGKKQMKCSLKGGNNDSWMNPLAKQFSNMGLLSQTEDNPSSKMDLSVGSLSDKKFDVDKRAMNLGDFNDIMRKDRSGFRPPNSKDMGTTDSGPYFEKLTLPFSNQDGCLGDEAPCSPFSPSPSYKLSPSGSTLPNVSLGAIGTGLNPQNFAARQGGSHGLFGNSTAQSRGLHTPVQPLNSSPSLRAQVPPQFISPQVSASMLKQFPNSGLSPGLFNVGPQLSPQQIAMLSQLPQIPQFQLACQLLLQQQQQQQLLQNQRKISQAVRQQQEQQLARMVSALQQQQQQQQRQPGMKHSPSHPVGPKPHLDNMVPNALNVGLPDLQTKGPIPGYGSGFSSGGMDYGMVGGKEAGTESRFKQWTSMMEGLPSVATQEANMHKNGAIVAPGKTRGGSPYNQFDIIPGDTLGGHTGPAGDSWLPAKSPPTNKIGSKSSNASWPPEFQPGVPWKGIQNIDPESDPYVTPGSVLGGTATSPIVDTDHQLLRDNTTGSNSSLNTSLPSPGAWPYSASDNSFTNVHSTSAKFPDYKSTWSPDPIGHNPTHLSNKMWKNHISSRNTTPLPRPPPGLTNPKPSSPWSSTAPRSVRGWGTQDSRLASASTWSDGGSVRPSYWLVLHNLTPQIDGSTLRTICMQHGPLLTFHLNLTQGTALIRYSTKQEAAKAQTALHMCVLGNTTILAEFATDDEVSRFLAQAQPPTPAATPSAPAAGWQSLETGQNQSDPVGPALNLFGGSTGLGQWSSSAGGSSGADLAGASLWGPPNYSSSLWGVPTVEDPHRMGSPAPLLPGDLLGGGSDSI

SEQ ID NO: 8848 - protein, 1050 aa, Homo sapiens
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQVMAQRQQVQRRPAPVGLPNPRMQGPIQQPSISHQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 8849 - protein, 549 aa, Homo sapiens
MEGPRSAACRARPATSPGAVDLTAPPPPPLLRILNSRAAPATRTFADLCRSLLQPESRVLCRLQPVNCYPPAASTKLCPVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQQPPPRLINFQNHSPKPNGPVLPPHPQQLRYPPNQNIPRQAIKPNPLQMAFLAQQAIKQWQISSGQGTPSTTQNINTAACTVFDVRVLHHIPYWALNISSSERDSFLWFSSVYNLE

SEQ ID NO: 8850 - protein, 1016 aa, Homo sapiens
MEVAVEKAVAAAAAASAAASGGPSAAPSGENEAESRQGPDSERGGEAARLNLLDTCAVCHQNIQSRAPKLLPCLHSFCQRCLPAPQRYLMLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 8851 - protein, 961 aa, Homo sapiens
MLPAPMLGSAETPPPVPAPGSPVSGSSPFATQVGVIRCPVCSQECAERHIIDNFFVKDTTEVPSSTVEKSNQVCTSCEDNAEANGFCVECVEWLCKTCIRAHQRVKFTKDHTVRQKEEVSPEAVGVTSQRPVFCPFHKKEQLKLYCETCDKLTCRDCQLLEHKEHRYQFIEEAFQNQKVIIDTLITKLMEKTKYIKFTGNQIQNRIIEVNQNQKQVEQDIKVAIFTLMVEINKKGKALLHQLESLAKDHRMKLMQQQQEVAGLSKQLEHVMHFSKWAVSSGSSTALLYSKRLITYRLRHLLRARCDASPVTNNTIQFHCDPSFWAQNIINLGSLVIEDKESQPQMPKQNPVVEQNSQPPSGLSSNQLSKFPTQISLAQLRLQHMQQQVMAQRQQVQRRPAPVGLPNPRMQGPIQQPSISHQQPPPRLINFQNHSPKPNGPVLPPHPQQLRYPPNQNIPRQAIKPNPLQMAFLAQQAIKQWQISSGQGTPSTTNSTSSTPSSPTITSAAGYDGKAFGSPMIDLSSPVGGSYNLPSLPDIDCSSTIMLDNIVRKDTNIDHGQPRPPSNRTVQSPNSSVPSPGLAGPVTMTSVHPPIRSPSASSVGSRGSSGSSSKPAGADSTHKVPVVMLEPIRIKQENSGPPENYDFPVVIVKQESDEESRPQNANYPRSILTSLLLNSSQSSTSEETVLRSDAPDSTGDQPGLHQDNSSNGKSEWLDPSQKSPLHVGETRKEDDPNEDWCAVCQNGGELLCCEKCPKVFHLSCHVPTLTNFPSGEWICTFCRDLSKPEVEYDCDAPSHNSEKKKTEGLVKLTPIDKRKCERLLLFLYCHEMSLAFQDPVPLTVPDYYKIIKNPMDLSTIKKRLQEDYSMYSKPEDFVADFRLIFQNCAEFNEPDSEVANAGIKLENYFEELLKNLYPEKRFPKPEFRNESEDNKFSDDSDDDFVQPRKKRLKSIEERQLLK

SEQ ID NO: 8852 - protein, 563 aa, Homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPQALAPHVDFVGGLHRFPPTSSLRQRPEPQVTGTVGLHLGVTPSVIRKRYNLTSQDVGSGTSNNSQACAQFLEQYFHDSDLAQFMRLFGGNFAHQASVARVVGQQGRGRAGIEASLDVQYLMSAGANISTWVYSSPGRHEGQEPFLQWLMLLSNESALPHVHTVSYGDDEDSLSSAYIQRVNTELMKAAARGLTLLFASGDSGAGCWSVSGRHQFRPTFPASSPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 8853 - protein, 346 aa, Homo sapiens
MGLQACLLGLFALILSGKCSYSPEPDQRRTLPPGWVSLGRADPEEELSLTFALRQQNVERLSELVQAVSDPSSPQYGKYLTLENVADLVRPSPLTLHTVQKWLLAAGAQKCHSVITQDFLTCWLSIRQAELLLPGAEFHHYVGGPTETHVVRSPHPYQLPHILEVPYVTTVGGTSFQEPFLITNEIVDYISGGGFSNVFPRPSYQEEAVTKFLSSSPHLPPSSYFNASGRAYPDVAALSDGYWVVSNRVPIPWVSGTSASTPVFGGILSLINEHRILSGRPPLGFLNPRLYQQHGAGLFDVTRGCHESCLDEEVEGQGFCSGPGWDPVTGWGTPNFPALLKTLLNP

SEQ ID NO: 8854 - protein, 1164 aa, Homo sapiens
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKEERMDSARPCLHRQHHLLNDRGSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 8855 - protein, 366 aa, Homo sapiens
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQVWCQLVCLLSPLLSGEADPLGQI

SEQ ID NO: 8856 - protein, 317 aa, Homo sapiens
MDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPSVIRMTTCTFHSPRPQSHPPGRKREWILQDHVYTDNTIF

SEQ ID NO: 8857 - protein, 1164 aa, Homo sapiens; identical to SEQ ID NO: 8854

SEQ ID NO: 8858 - protein, 282 aa, Homo sapiens
MDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGHLATTVRPRPPGPAAPGAVVEAEVVEAAAAAAASFLPQRNPHTRGQAHSAVGGRRLWEKRLPASPPLWAHFPVQKASWV

SEQ ID NO: 8859 - protein, 1113 aa, Homo sapiens
MAQQANVGELLAMLDSPMLGVRDDVTAVFKENLNSDRGPMLVNTLVDYYLETSSQPALHILTTLQEPHDKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKEERMDSARPCLHRQHHLLNDRGSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 8860 - protein, 1807 aa, Homo sapiens
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSLRIARPPKQGLNNSPPVKEFKESSAAEAFRCRSISVSEHVVRSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTVASFSSLYQSSCQGQLHRSVSWADSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 8861 - protein, 1784 aa, Homo sapiens
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSLRIARPPKQGLNNSPPVKEFKESSAAEAFRCRSISVSEHVVRSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 8862 - protein, 1764 aa, Homo sapiens
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTVASFSSLYQSSCQGQLHRSVSWADSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 8863 - protein, 1692 aa, Homo sapiens
MECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 8864 - protein, 1741 aa, Homo sapiens
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 8865 - protein, 1704 aa, Homo sapiens
MAKPTSKDSGLKEKFKILLGLGTPRPNPRSAEGKQTEFIITAEILRELSMECGLNNRIRMIGQICEVAKTKKFEEGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTDSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 8866 - protein, 171 aa, Homo sapiens
FPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 8867 - protein, 101 aa, Homo sapiens
MAMMEVQGGPSLGQTCVLIVIFTVLLQSLCVAVTYVYFTNELKQMQDKYSKSGIACFLKEDDSYWDPNDEESMNSPCWQVKWQLRQLVRKTPRMKRLWAAK

SEQ ID NO: 8868 - protein, 281 aa, Homo sapiens [sequence omitted]

SEQ ID NO: 8869 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 8870 - protein, 266 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 8871 - protein, 164 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGFIY

SEQ ID NO: 8872 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 8873 - protein, 468 aa, Homo sapiens
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAREKIQDLLVDSGKFIYLEDGTGSAVSLE

SEQ ID NO: 8874 - protein, 440 aa, Homo sapiens
MEQRGQNAPAASGARKRHGPGPREARGARPGPRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEVPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 8875 - protein, 411 aa, Homo sapiens
MEQRGQNAPAASGARKRHGPGPREARGARPGPRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 8876 - protein, 260 aa, Homo sapiens
MCRKCRTGCPRGMVKVGDCTPWSDIECVHKESGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 8877 - protein, 386 aa, Homo sapiens
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVELPEEPQRLLEQAEAEGCQRRRLLVPVNDADSADISTLLDASATLEEGHAKETIQDQLVGSEKLFYEEDEAGSATSCL

SEQ ID NO: 8878 - protein, 455 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 8879 - protein, 218 aa, Homo sapiens
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSKVLLCRPGWNAVARSRLTATSASQIQAILLLQPPK

SEQ ID NO: 8880 - protein, 461 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 8881 - protein, 268 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVVSLSSS

SEQ ID NO: 8882 - protein, 155 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPDLS

SEQ ID NO: 8883 - protein, 37 aa, Homo sapiens
MAPVAVWAALAVGLELWAAAHALPAQVDPGPLFPHPG

SEQ ID NO: 8884 - protein, 655 aa, Homo sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 8885 - protein, 344 aa, Homo sapiens
SCCRPWRPLGARSPARPSRPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 8886 - protein, 372 aa, Homo sapiens
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 8887 - protein, 234 aa, Homo sapiens
MEQRPRGCAAVAAALLLVLLGARAQGGTRSPRCDCAGDFHKKIGLFCCRGCPADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 8888 - protein, 380 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQNEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 8889 - protein, 417 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 8890 - protein, 426 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRVGVFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 8891 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 8892 - protein, 1972 aa, Homo sapiens
MDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 8893 - protein, 1927 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 8894 - protein, 1977 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 8895 - protein, 1975 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 8896 - protein, 540 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 8897 - protein, 499 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVRTWGP

SEQ ID NO: 8898 - protein, 555 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 8899 - protein, 426 aa, Homo sapiens
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQFFNRIGVSKLHRVFHLPRVTEHLPPAEPDH

SEQ ID NO: 8900 - protein, 450 aa, Homo sapiens
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVRTWGP

SEQ ID NO: 8901 - protein, 587 aa, Homo sapiens
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 8902 - protein, 565 aa, Homo sapiens
MDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 8903 - protein, 636 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 8904 - protein, 110 aa, Homo sapiens
MGASGSKARGLWPFASAAGGGGSEAAGAEQALVRPRGRAVPPFVFTRRGSMFYDEDGDLAHEFYEETIVTKNGQKRAKLRRVHKNLIPQGIVKLDHPRIHVDFPVILYEV

SEQ ID NO: 8905 - protein, 202 aa, Homo sapiens
MMQDVSSSPVSPADDSLSNSEEEPDRQQPPSGKRGGRKRRSSRRSAGGGAGPGGAAGGGVGGGDEPGSPAQGKRGKKSAGCGGGGGAGGGGGSSSGGGSPQSYEELQTQRVMANVRERQRTQSLNEAFAALRKIIPTLPSDKLSKIQTLKLAARYIDFLYQVLQSDELDSKMASCSYVAHERLSYAFSVWRMEGAWSMSASH

SEQ ID NO: 8906 - protein, 246 aa, Homo sapiens
MGDREQLLQRARLAEQAERYDDMASAMKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKNSVVEASEAAYKEAFEISKEQMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 8907 - protein, 541 aa, Homo sapiens
MVWRVPPFLLPILFLGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 8908 - protein, 1138 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 8909 - protein, 783 aa, Homo sapiens
MASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 8910 - protein, 317 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEVHQGHCGAREDHS

SEQ ID NO: 8911 - protein, 421 aa, Homo sapiens
MRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 8912 - protein, 379 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSGWRDWVDTSTEKQNTDEGRFGGHVSAPVGAPG

SEQ ID NO: 8913 - protein, 272 aa, Homo sapiens
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 8914 - protein, 187 aa, Homo sapiens
MQPIDTCVSYPRTGGQGSVSHFPGCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 8915 - protein, 231 aa, Homo sapiens
MALLVRVLRNQTSISQWVPVCSRLIPVSPTQGQGDRALSRTSQKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 8916 - protein, 273 aa, Homo sapiens
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGGILSDDHGLAAALWRTFFNRKCEDPRHLELLVEYVRKQIQYLDSMNGEDLLLTGEVSWRPLVEKNPQSILKPHSPTYNDEGL

SEQ ID NO: 8917 - protein, 299 aa, Homo sapiens
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 8918 - protein, 200 aa, Homo sapiens
MGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 8919 - protein, 162 aa, Homo sapiens
MALLVRVLRNQTSISQWVPVCSRLIPVSPTQGQGDRALSRTSQWPQMSQSRACGGSEQIPGIDIQLNRKYHTTPILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 8920 - protein, 144 aa, Homo sapiens
MCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 8921 - protein, 148 aa, Homo sapiens
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYSKWDVSSPNEAGRPEWEVHVSYHSSFYVGGCSAARQSHGG

SEQ ID NO: 8922 - protein, 274 aa, Homo sapiens
MLSVASRSGPFAPVLSATSRGVAGALRPLVQATVPATPEQPVLDLKRPFLSRESLSGQAVRRPLVASVGLNVPASVCYSHTDIKVPDFSEYRRLEVLDSTKSSRESSEARKGFSYLVTGVTTVGVAYAAKNAVTQFVSSMSASADVLALAKIEIKLSDIPEGKNMAFKWRGKPLFVRHRTQKEIEQEAAVELSQLRDPQHDLDRVKKPEWVILIGVCTHLGCVPIANAGDFGGYYCPCHGSHYDASGRIRLGPAPLNLEVPTYEFTSDDMVIVG

SEQ ID NO: 8923 - protein, 858 aa, Homo sapiens
MAELSEEALLSVLPTIRVPKAGDRVHKDECAFSFDTPESEGGLYICMNTFLGFGKQYVERHFNKTGQRVYLHLRRTRRPKEEDPATGTGDPPRKKPTRLAIGVEGGFDLSEEKFELDEDVKIVILPDYLEIARDGLGGLPDIVRDRVTSAVEALLSADSASRKQEVQAWDGEVRQVSKHAFSLKQLDNPARIPPCGWKCSKCDMRENLWLNLTDGSILCGRRYFDGSGGNNHAVEHYRETGYPLAVKLGTITPDGADVYSYDEDDMVLDPSLAEHLSHFGIDMLKMQKTDKTMTELEIDMNQRIGEWELIQESGVPLKPLFGPGYTGIRNLGNSCYLNSVVQVLFSIPDFQRKYVDKLEKIFQNAPTDPTQDFSTQVAKLGHGLLSGEYSKPVPESGDGERVPEQKEVQDGIAPRMFKALIGKGHPEFSTNRQQDAQEFFLHLINMVERNCRSSENPNEVFRFLVEEKIKCLATEKVKYTQRVDYIMQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKGSLGFYGNEDEDSFCSPHFSSPTSPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 8924 - protein, 835 aa, Homo sapiens
MAELSEEALLSVLPTIRVPKAGDRVHKDECAFSFDTPESEGGLYICMNTFLGFGKQYVERHFNKTGQRVYLHLRRTRRPKEEDPATGTGDPPRKKPTRLAIGVEGGFDLSEEKFELDEDVKIVILPDYLEIARDGLGGLPDIVRDRVTSAVEALLSADSASRKQEVQAWDGEVRQVSKHAFSLKQLDNPARIPPCGWKCSKCDMRENLWLNLTDGSILCGRRYFDGSGGNNHAVEHYRETGYPLAVKLGTITPDGADVYSYDEDDMVLDPSLAEHLSHFGIDMLKMQKTDKTMTELEIDMNQRIGEWELIQESGVPLKPLFGPGYTGIRNLGNSCYLNSVVQVLFSIPDFQRKYVDKLEKIFQNAPTDPTQDFSTQVAKLGHGLLSGEYSKPVPESGDGERVPEQKEVQDGIAPRMFKALIGKGHPEFSTNRQQDAQEFFLHLINMVERNCRSSENPNEVFRFLVEEKIKCLATEKVKYTQRVDYIMQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKAPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 8925 - protein, 794 aa, Homo sapiens
MADAWEEIRRLAADFQRAQFAEATQRLSERNCIEIVNKLIAQKQLEVVHTLDGKEYITPAQISKEMRDELHVRGGRVNIVDLQQVINVDLIHIENRIGDIIKSEKHVQLVLGQLIDENYLDRLAEEVNDKLQESGQVTISELCKTYDLPGNFLTQALTQRLGRIISGHIDLDNRGVIFTEAFVARHKARIRGLFSAITRPTAVNSLISKYGFQEQLLYSVLEELVNSGRLRGTVVGGRQDKAVFVPDIYSRTQSTWVDSFFRQNGYLEFDALSRLGIPDAVSYIKKRYKTTQLLFLKAACVGQGLVDQVEASVEEAISSGTWVDIAPLLPTSLSVEDAAILLQQVMRAFSKQASTVVFSDTVVVSEKFINDCTELFRELMHQKAEKEMKNNPVHLITEEDLKQISTLESVSTSKKDKKDERRRKATEGSGSMRGGGGGNAREYKIKKVKKKGRKDDDSDDESQSSHTGKKKPEISFMFQDEIEDFLRKHIQDAPEEFISELAEYLIKPLNKTYLEVVRSVFMSSTTSASGTGRKRTIKDLQEEVSNLYNNIRLFEKGMKFFADDTQAALTKHLLKSVCTDITNLIFNFLASDLMMAVDDPAAITSEIRKKILSKLSEETKVALTKLHNSLNEKSIEDFISCLDSAAEACDIMVKRGDKKRERQILFQHRQALAEQLKVTEDPALILHLTSVLLFQFSTHSMLHAPGRCVPQIIAFLNSKIPEDQHALLVKYQGLVVKQLVSQSKKTGQGDYPLNNELDKEQEDVASTTRKELQELSSSIKDLVLKSRKSSVTEE

SEQ ID NO: 8926 - protein, 313 aa, Homo sapiens
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 8927 - protein, 304 aa, Homo sapiens
MGVFCLGPWGLGRKLRTPGKGPLQLLSRLCGDHLQAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 8928 - protein, 270 aa, Homo sapiens
MGVFCLGPWGLGRKLRTPGKGPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 8929 - protein, 3095 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQKIQFYREWIMTHSSSSDDDDDDDDDDESDLNH

SEQ ID NO: 8930 - protein, 3174 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 8931 - protein, 3069 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLALKLSTNEDIITLQILAELSCLQIFIQDQKCNISEIKIEGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQASKSLI

SEQ ID NO: 8932 - protein, 3135 aa, Homo sapiens
MVFESVVVDVLNRFLGDYVVDLDTSQLSLGIWKGAVALKNLQIKENALSQLDVPFKVKVGHIGNLKLIIPWKNLYTQPVEAVLEEIYLLIVPSSRIKYDPLKEEKQLMEAKQQELKRIEEAKQKVVDQEQHLPEKQDTFAEKLVTQIIKNLQVKISSIHIRYEDDITNRDKPLSFGISLQNLSMQTTDQYWVPCLHDETEKLVRKLIRLDNLFAYWNVKSQMFYLSDYDNSLDDLKNGIVNENIVPEGYDFVFRPISANAKLVMNRRSDFDFSAPKINLEIELHNIAIEFNKPQYFSIMELLESVDMMAQNLPYRKFKPDVPLHHHAREWWAYAIHGVLEVNVCPRLWMWSWKHIRKHRQKVKQYKELYKKKLTSKKPPGELLVSLEELEKTLDVFNITIARQTAEVEVKKAGYKIYKEGVKDPEDNKGWFSWLWSWSEQNTNEQQPDVQPETLEEMLTPEEKALLYEAIGYSETAVDPTLLKTFEALKFFVHLKSMSIVLRENHQKPELVDIVIEEFSTLIVQRPGAQAIKFETKIDSFHITGLPDNSEKPRLLSSLDDAMSLFQITFEINPLDETVSQRCIIEAEPLEIIYDARTVNSIVEFFRPPKEVHLAQLTAATLTKLEEFRSKTATGLLYIIETQKVLDLKINLKASYIIVPQDGIFSPTSNLLLLDLGHLKVTSKSRSELPDVKQGEANLKEIMDRAYDSFDIQLTSVQLLYSRVGDNWREARKLSVSTQHILVPMHFNLELSKAMVFMDVRMPKFKIYGKLPLISLRISDKKLQGIMELIESIPKPEPVTEVSAPVKSFQIQTSTSLGTSQISQKIIPLLELPSVSEDDSEEEFFDAPCSPLEEPLQFPTGVKSIRTRKLQKQDCSVNMTTFKIRFEVPKVLIEFYHLVGDCELSVVEILVLGLGAEIEIRTYDLKANAFLKEFCLKCPEYLDENKKPVYLVTTLDNTMEDLLTLEYVKAEKNVPDLKSTYNNVLQLIKVNFSSLDIHLHTEALLNTINYLHNILPQSEEKSAPVSTTETEDKGDVIKKLGLDSEMIMRPSETEINAKLRNIIVLDSDITAIYKKAVYITGKEVFSFKMVSYMDATAGSAYTDMNVVDIQVNLIVGCIEVVFVTKFLYSILAFIDNFQAAKQALAEATVQAAGMAATGVKELAQRSSRMALDINIKAPVVVIPQSPVSENVFVADFGLITMTNTFHMITESQSSPPPVIDLITIKLSEMRLYRSRFINDAYQEVLDLLLPLNLEVVVERNLCWEWYQEVPCFNVNAQLKPMEFILSQEDITTIFKTLHGNIWYEKDGSASPAVTKDQYSATSGVTTNASHHSGGATVVTAAVVEVHSRALLVKTTLNISFKTDDLTMVLYSPGPKQASFTDVRDPSLKLAEFKLENIISTLKMYTDGSTFSSFSLKNCILDDKRPHVKKATPRMIGLTVGFDKKDMMDIKYRKVRDGCVTDAVFQEMYICASVEFLQTVANVFLEAYTTGTAVETSVQTWTAKEEVPTQESVKWEINVIIKNPEIVFVADMTKNDAPALVITTQCEICYKGNLENSTMTAAIKDLQVRACPFLPVKRKGKITTVLQPCDLFYQTTQKGTDPQVIDMSVKSLTLKVSPVIINTMITITSALYTTKETIPEETASSTAHLWEKKDTKTLKMWFLEESNETEKIAPTTELVPKGEMIKMNIDSIFIVLEAGIGHRTVPMLLAKSRFSGEGKNWSSLINLHCQLELEVHYYNEMFGVWEPLLEPLEIDQTEDFRPWNLGIKMKKKAKMAIVESDPEEENYKVPEYKTVISFHSKDQLNITLSKCGLVMLNNLVKAFTEAATGSSADFVKDLAPFMILNSLGLTISVSPSDSFSVLNIPMAKSYVLKNGESLSMDYIRTKDNDHFNAMTSLSSKLFFILLTPVNHSTADKIPLTKVGRRLYTVRHRESGVERSIVCQIDTVEGSKKVTIRSPVQIRNHFSVPLSVYEGDTLLGTASPENEFNIPLGSYRSFIFLKPEDENYQMCEGIDFEEIIKNDGALLKKKCRSKNPSKESFLINIVPEKDNLTSLSVYSEDGWDLPYIMHLWPPILLRNLLPYKIAYYIEGIENSVFTLSEGHSAQICTAQLGKARLHLKLLDYLNHDWKSEYHIKPNQQDISFVSFTCVTEMEKTDLDIAVHMTYNTGQTVVAFHSPYWMVNKTGRMLQYKADGIHRKHPPNYKKPVLFSFQPNHFFNNNKVQLMVTDSELSNQFSIDTVGSHGAVKCKGLKMDYQVGVTIDLSSFNITRIVTFTPFYMIKNKSKYHISVAEEGNDKWLSLDLEQCIPFWPEYASSKLLIQVERSEDPPKRIYFNKQENCILLRLDNELGGIIAEVNLAEHSTVITFLDYHDGAATFLLINHTKNELVQYNQSSLSEIEDSLPPGKAVFYTWADPVGSRRLKWRCRKSHGEVTQKDDMMMPIDLGEKTIYLVSFFEGLQRIILFTEDPRVFKVTYESEKAELAEQEIAVALQDVGISLVNNYTKQEVAYIGITSSDVVWETKPKKKARWKPMSVKHTEKLEREFKEYTESSPSEDKVIQLDTNVPVRLTPTGHNMKILQPHVIALRRNYLPALKVEYNTSAHQSSFRIQIYRIQIQNQIHGAVFPFVFYPVKPPKSVTMDSAPKPFTDVSIVMRSAGHSQISRIKYFKVLIQEMDLRLDLGFIYALTDLMTEAEVTENTEVELFHKDIEAFKEEYKTASLVDQSQVSLYEYFHISPIKLHLSVSLSSGREEAKDSKQNGGLIPVHSLNLLLKSIGATLTDVQDVVFKLAFFELNYQFHTTSDLQSEVIRHYSKQAIKQMYVLILGLDVLGNPFGLIREFSEGVEAFFYEPYQGAIQGPEEFVEGMALGLKALVGGAVGGLAGAASKITGAMAKGVAAMTMDEDYQQKRREAMNKQPAGFREGITRGGKGLVSGFVSGITGIVTKPIKGAQKGGAAGFFKGVGKGLVGAVARPTGGIIDMASSTFQGIKRATETSEVESLRPPRFFNEDGVIRPYRLRDGTGNQMLQVMENGRFAKYKYFTHVMINKTDMLMITRRGVLFVTKGTFGQLTCEWQYSFDEFTKEPFIVHGRRLRIEAKERVKSVFHAREFGKIINFKTPEDARWILTKLQEAREPSPSL

SEQ ID NO: 8933 - protein, 438 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 8934 - protein, 147 aa, Homo sapiens [sequence omitted]

SEQ ID NO: 8935 - protein, 382 aa, Homo sapiens
MRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 8936 - protein, 133 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTT

SEQ ID NO: 8937 - protein, 481 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 8938 - protein, 133 aa, Homo sapiens; identical to SEQ ID NO: 8936

SEQ ID NO: 8939 - protein, 96 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDER

SEQ ID NO: 8940 - protein, 119 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDP

SEQ ID NO: 8941 - protein, 481 aa, Homo sapiens; identical to SEQ ID NO: 8937

SEQ ID NO: 8942 - protein, 67 aa, Homo sapiens
MNEVSVIKEGWLHKRGEYIKTWRPRYFLLKSDGSFIGYKERPEAPDQTLPPLNNFSVAECQLMKTER

SEQ ID NO: 8943 - protein, 47 aa, Homo sapiens
MNEVSVIKEGWLHKRGEYIKTWRPRYFLLKSDGSFIGYKERPEAPDQ

SEQ ID NO: 8944 - protein, 134 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTE

SEQ ID NO: 8945 - protein, 107 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVA

SEQ ID NO: 8946 - protein, 288 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTVSCPPLPRQCEASLWTELRERALIFWYKAQSWGRPGGQGKVLLRPAKSSEPRHVVGVSRLGEWEGDSFFIDGGFM

SEQ ID NO: 8947 - protein, 479 aa, Homo sapiens
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKYDEDGMDCMDNERRPHFPQFSYSASGRE

SEQ ID NO: 8948 - protein, 465 aa, Homo sapiens
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKCQQSDCGMLGNWKK

SEQ ID NO: 8949 - protein, 479 aa, Homo sapiens; identical to SEQ ID NO: 8947

SEQ ID NO: 8950 - protein, 465 aa, Homo sapiens; identical to SEQ ID NO: 8948

SEQ ID NO: 8951 - protein, 139 aa, Homo sapiens
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTH

SEQ ID NO: 8952 - protein, 207 aa, Homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 8953 - protein, 188 aa, Homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDSPRPLCPRCTQHHQRPDPRTCRCRCRRRSFLRCQGRGLELNPDTCRCRKLRR

SEQ ID NO: 8954 - protein, 380 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKRQQPGPSEHIERRVSNAGGPPAPPAGGPPPPPGPPPPPGPPPPPGLPPSGVPAAAHGAGGGPPPAPPLPAAQGPGGGGAGAPGLAAAIAGAKLRKVSKQEEASGGPTAPKAESGRSGGGGLMEEMNAMLARRRKATQVGEKTPKDESANQEEPEARVPAQSESVRRPWEKNSTTLPRMKSSSSVTTSETQPCTPSSSDYSDLQRVKQELLEEVKKELQKVKEEIIEAFVQELRKRGSP

SEQ ID NO: 8955 - protein, 304 aa, Homo sapiens
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGNQEGSHPQPLGGPEPGPYAQPSVNTPLPNLQNGPIYARVIQKRVPNAYDKTALALEVGELVKVTKINVSGQWEGECNGKRGHFPFTHVRLLDQQNPDEDFS

SEQ ID NO: 8956 - protein, 204 aa, Homo sapiens
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYLDTTTLIEPVSRSRQGSGVILRQEEAEYVRALFDFNGNDEEDLPFKKGDILRIRDKPEEQWWNAEDSEGKRGMIPVPYVEKYRPASASVSALIGGR

SEQ ID NO: 8957 - protein, 731 aa, Homo sapiens
  MOD_RES (1)..(1): Any amino acid
XKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCIGSSIEDCIGLMDRTPLIAAGVIGGLFILVIVGLTFAVYVRRKSIKKKRALRRFLETELVEPLTPSGTAPNQAQLRILKETELKRVKVLGSGAFGTVYKGIWVPEG

SEQ ID NO: 8958 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 8959 - protein, 1298 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCIGSSIEDCIGLMDRTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 8960 - protein, 128 aa, Homo sapiens
MGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCG

SEQ ID NO: 8961 - protein, 1292 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 8962 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 8963 - protein, 331 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKVF

SEQ ID NO: 8964 - protein, 183 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTGQFPMVPSGLTPQPAQDWYLLDDDPRLLTLSASSKVPVTLAAV

SEQ ID NO: 8965 - protein, 1283 aa, Homo sapiens
MGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 8966 - protein, 699 aa, Homo sapiens
MALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 8967 - protein, 126 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTN

SEQ ID NO: 8968 - protein, 921 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGQCIWMPSLPSLAPVSNLPFETPS

SEQ ID NO: 8969 - protein, 3396 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 8970 - protein, 1642 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 8971 - protein, 2409 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRRMSDLSVIGHPIDSESKEDEPCSEETDPVHDLMAEILPEFPDIIEIDLYHSEENEEEEEECANATDVTTTPSVQYINGKHLVTTVPKDPEAAEARRGQFESVAPSQNFSDSSESDTHPFVIAKTELSTAVQPNESTETTESLEVTWKPETYPETSEHFSGGEPDVFPTVPFHEEFESGTAKKGAESVTERDTEVGHQAHEHTEPVSLFPEESSGEIAIDQESQKIAFARATEVTFGEEVEKSTSVTYTPTIVPSSASAYVSEEEAVTLIGNPWPDDLLSTKESWVEATPRQVVELSGSSSIPITEGSGEAEEDEDTMFTMVTDLSQRNTTDTLITLDTSRIITESFFEVPATTIYPVSEQPSAKVVPTKFVSETDTSEWISSTTVEEKKRKEEEGTTGTASTFEVYSSTQRSDQLILPFELESPNVATSSDSGTRKSFMSLTTPTQSEREMTDSTPVFTETNTLENLGAQTTEHSSIHQPGVQEGLTTLPRSPASVFMEQGSGEAAADPETTTVSSFSLNVEYAIQAEKEVAGTLSPHVETTFSTEPTGLVLSTVMDRVVAENITQTSREIVISERLGEPNYGAEIRGFSTGFPLEEDFSGDFREYSTVSHPIAKEETVMMEGSGDAAFRDTQTSPSTVPTSVHISHISDSEGPSSTMVSTSAFPWEEFTSSAEGSGEQLVTVSSSVVPVLPSAVQKFSGTASSIIDEGLGEVGTVNEIDRRSTILPTAEVEGTKAPVEKEEVKVSGTVSTNFPQTIEPAKLWSRQEVNPVRQEIESETTSEEQIQEEKSFESPQNSPATEQTIFDSQTFTETELKTTDYSVLTTKKTYSDDKEMKEEDTSLVNMSTPDPDANGLESYTTLPEATEKSHFFLATALVTESIPAEHVVTDSPIKKEESTKHFPKGMRPTIQESDTELLFSGLGSGEEVLPTLPTESVNFTEVEQINNTLYPHTSQVESTSSDKIEDFNRMENVAKEVGPLVSQTDIFEGSGSVTSTTLIEILSDTGAEGPTVAPLPFSTDIGHPQNQTVRWAEEIQTSRPQTITEQDSNKNSSTAEINETTTSSTDFLARAYGFEMAKEFVTSAPKPSDLYYEPSGEGSGEVDIVDSFHTSATTQATRQESSTTFVSDGSLEKHPEVPSAKAVTADGFPTVSVMLPLHSEQNKSSPDPTSTLSNTVSYERSTDGSFQDRFREFEDSTLKPNRKKPTENIIIDLDKEDKDLILTITESTILEILPELTSDKNTIIDIDHTKPVYEDILGMQTDIDTEVPSEPHDSNDESNDDSTQVQEIYEAAVNLSLTEETFEGSADVLASYTQATHDESMTYEDRSQLDHMGFHFTTGIPAPSTETELDVLLPTATSLPIPRKSATVIPEIEGIKAEAKALDDMFESSTLSDGQAIADQSEIIPTLGQFERTQEEYEDKKHAGPSFQPEFSSGAEEALVDHTPYLSIATTHLMDQSVTEVPDVMEGSNPPYYTDTTLAVSTFAKLSSQTPSSPLTIYSGSEASGHTEIPQPSALPGIDVGSSVMSPQDSFKEIHVNIEATFKPSSEEYLHITEPPSLSPDTKLEPSEDDGKPELLEEMEASPTELIAVEGTEILQDFQNKTDGQVSGEAIKMFPTIKTPEAGTVITTADEIELEGATQWPHSTSASATYGVEAGVVPWLSPQTSERPTLSSSPEINPETQAALIRGQDSTIAASEQQVAARILDSNDQATVNPVEFNTEVATPPFSLLETSNETDFLIGINEESVEGTAIYLPGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 8972 - protein, 1594 aa, Homo sapiens
MPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKPKEATTIDLSILAETASPSLSKEPQMVSDRTTPIIPLVDELPVIPTEFPPVGNIVSFEQKATVQPQAITDSLATKLPTPTGSTKKPWDMDDYSPSASGPLGKLDISEIKEEVLQSTTGVSHYATDSWDGVVEDKQTQESVTQIEQIEVGPLVTSMEILKHIPSKEFPVTETPLVTARMILESKTEKKMVSTVSELVTTGHYGFTLGEEDDEDRTLTVGSDESTLIFDQIPEVITVSKTSEDTIHTHLEDLESVSASTTVSPLIMPDNNGSSMDDWEERQTSGRITEEFLGKYLSTTPFPSQHRTEIELFPYSGDKILVEGISTVIYPSLQTEMTHRRERTETLIPEMRTDTYTDEIQEEITKSPFMGKTEEEVFSGMKLSTSLSEPIHVTESSVEMTKSFDFPTLITKLSAEPTEVRDMEEDFTATPGTTKYDENITTVLLAHGTLSVEAATVSKWSWDEDNTTSKPLESTEPSASSKLPPALLTTVGMNGKDKDIPSFTEDGADEFTLIPDSTQKQLEEVTDEDIAAHGKFTIRFQPTTSTGIAEKSTLRDSTTEEKVPPITSTEGQVYATMEGSALGEVEDVDLSKPVSTVPQFAHTSEVEGLAFVSYSSTQEPTTYVDSSHTIPLSVIPKTDWGVLVPSVPSEDEVLGEPSQDILVIDQTRLEATISPETMRTTKITEGTTQEEFPWKEQTAEKPVPALSSTAWTPKEAVTPLDEQEGDGSAYTVSEDELLTGSERVPVLETTPVGKIDHSVSYPPGAVTEHKVKTDEVVTLTPRIGPKVSLSPGPEQKYETEGSSTTGFTSSLSPFSTHITQLMEETTTEKTSLEDIDLGSGLFEKPKATELIEFSTIKVTVPSDITTAFSSVDRLHTTSAFKPSSAITKKPPLIDREPGEETTSDMVIIGESTSHVPPTTLEDIVAKETETDIDREYFTTSSPPATQPTRPPTVEDKEAFGPQALSTPQPPASTKFHPDINVYIIEVRENKTGPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 8973 - protein, 655 aa, Homo sapiens
MFINIKSILWMCSTLIVTHALHKVKVGKSPPVRGSLSGKVSLPCHFSTMPTLPPSYNTSEFLRIKWSKIEVDKNGKDLKETTVLVAQNGNIKIGQDYKGRVSVPTHPEAVGDASLTVVKLLASDAGLYRCDVMYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQDARLATVGELQAAWRNGFDQCDYGWLSDASVRHPVTVARAQCGGGLLGVRTLYRFENQTGFPPPDSRFDAYCFKRPDRCKMNPCLNGGTCYPTETSYVCTCVPGYSGDQCELDFDECHSNPCRNGATCVDGFNTFRCLCLPSYVGALCEQDTETCDYGWHKFQGQCYKYFAHRRTWDAAERECRLQGAHLTSILSHEEQMFVNRVGHDYQWIGLNDKMFEHDFRWTDGSTLQYENWRPNQPDSFFSAGEDCVVIIWHENGQWNDVPCNYHLTYTCKKGTVACGQPPVVENAKTFGKMKPRYEINSLIRYHCKDGFIQRHLPTIRCLGNGRWAIPKITCMNPSAYQRTYSMKYFKNSSSAKDNSINTSKHDHRWSRRWQESRR

SEQ ID NO: 8974 - protein, 479 aa, Homo sapiens
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 8975 - protein, 363 aa, Homo sapiens
MVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 8976 - protein, 462 aa, Homo sapiens
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 8977 - protein, 486 aa, Homo sapiens
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 8978 - protein, 486 aa, Homo sapiens; identical to SEQ ID NO: 8977

SEQ ID NO: 8979 - protein, 171 aa, Homo sapiens
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADLPYEPPRRSAWTGHGHPTPQSKGTVLAPMTLSFMSQAVDDC

SEQ ID NO: 8980 - protein, 462 aa, Homo sapiens; identical to SEQ ID NO: 8976

SEQ ID NO: 8981 - protein, 387 aa, Homo sapiens
MVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 8982 - protein, 469 aa, Homo sapiens
MNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 8983 - protein, 469 aa, Homo sapiens; identical to SEQ ID NO: 8982

SEQ ID NO: 8984 - protein, 168 aa, Homo sapiens
MNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIK

SEQ ID NO: 8985 - protein, 270 aa, Homo sapiens
MNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNS

SEQ ID NO: 8986 - protein, 189 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 8987 - protein, 170 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGSRSGSSSSSGTLWDPPGPM

SEQ ID NO: 8988 - protein, 189 aa, Homo sapiens; identical to SEQ ID NO: 8986

SEQ ID NO: 8989 - protein, 170 aa, Homo sapiens; identical to SEQ ID NO: 8987

SEQ ID NO: 8990 - protein, 189 aa, Homo sapiens; identical to SEQ ID NO: 8986

SEQ ID NO: 8991 - protein, 170 aa, Homo sapiens; identical to SEQ ID NO: 8987

SEQ ID NO: 8992 - protein, 466 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTLLIKTVETRDGQVINETSQHHDDLE

SEQ ID NO: 8993 - protein, 173 aa, Homo sapiens
GFLVPLWLMRNCFRLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTVSTNPAVKEGK

SEQ ID NO: 8994 - protein, 228 aa, Homo sapiens
MRNCFRLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESR

SEQ ID NO: 8995 - protein, 431 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRGKHFISL

SEQ ID NO: 8996 - protein, 466 aa, Homo sapiens; identical to SEQ ID NO: 8992

SEQ ID NO: 8997 - protein, 407 aa, Homo sapiens
MFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRILCLFQTFPP

SEQ ID NO: 8998 - protein, 1134 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKPGIPAAEVGIGVVAEADAADAAGFPVPPDMEDDYEPELLLMPSNQPVNQPILAAAQSLHREATKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 8999 - protein, 1066 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 9000 - protein, 927 aa, Homo sapiens
MLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKPGIPAAEVGIGVVAEADAADAAGFPVPPDMEDDYEPELLLMPSNQPVNQPILAAAQSLHREATKWSSKGNDIIAAAKRMALLMAEMSRLVRGGSVPRTSPRPQMR

SEQ ID NO: 9001 - protein, 327 aa, Homo sapiens
MPVFHTRTIESILEPVAQQISHLVIMHEEGEVDGKAIPDLTAPVAAVQAAVSNLVRVGKETVQTTEDQILKRDMPPAFIKVENACTKLVQAAQMLQSDPYSVPARDYLIDGSRGILSGTSDLLLTFDEAEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 9002 - protein, 806 aa, Homo sapiens
GQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKPGIPAAEVGIGVVAEADAADAAGFPVPPDMEDDYEPELLLMPSNQPVNQPILAAAQSLHREATKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVREAEAASIKIRTDAGFTLRWVRKTPWYQ

SEQ ID NO: 9003 - protein, 1006 aa, Homo sapiens
MPPAFIKVENACTKLVQAAQMLQSDPYSVPARDYLIDGSRGILSGTSDLLLTFDEAEVRKIIRVCKGILEYLTVAEVVETMEDLVTYTKNLGPGMTKMAKMIDERQQELTHQEHRVMLVNSMNTVKELLPVLISAMKIFVTTKNSKNQGIEEALKNRNFTVEKMSAEINEIIRVLQLTSWDEDAWASKDTEAMKRALASIDSKLNQAKGWLRDPSASPGDAGEQAIRQILDEAGKVGELCAGKERREILGTCKMLGQMTDQVADLRARGQGSSPVAMQKAQQVSQGLDVLTAKVENAARKLEAMTNSKQSIAKKIDAAQNWLADPNGGPEGEEQIRGALAEARKIAELCDDPKERDDILRSLGEISALTSKLADLRRQGKGDSPEARALAKQVATALQNLQTKTNRAVANSRPAKAAVHLEGKIEQAQRWIDNPTVDDRGVGQAAIRGLVAEGHRLANVMMGPYRQDLLAKCDRVDQLTAQLADLAARGEGESPQARALASQLQDSLKDLKARMQEAMTQEVSDVFSDTTTPIKLLAVAATAPPDAPNREEVFDERAANFENHSGKLGATAEKAAAVGTANKSTVEGIQASVKTARELTPQVVSAARILLRNPGNQAAYEHFETMKNQWIDNVEKMTGLVDEAIDTKSLLDASEEAIKKDLDKCKVAMANIQPQMLVAGATSIARRANRILLVAKREVENSEDPKFREAVKAASDELSKTISPMVMDAKAVAGNISDPGLQKSFLDSGYRILGAVAKVREAFQPQEPDFPPPPPDLEQLRLTDELAPPKPPLPEGEVPPPRPPPPEEKDEEFPEQKAGEVINQPMMMAARQLHDEARKWSSKGNDIIAAAKRMALLMAEMSRLVRGGSGTKRALIQCAKDIAKASDEVTRLAKEVAKQCTDKRIRTNLLQVCERIPTISTQLKILSTVKATMLGRTNISDEESEQATEMLVHNAQNLMQSVKETVRELKLLQSKFEQMLDLHCAGLERLPGTSRHLAEPGWHRNLY

SEQ ID NO: 9004 - protein, 189 aa, Homo sapiens [sequence omitted]

SEQ ID NO: 9005 - protein, 188 aa, Homo sapiens [sequence omitted]

SEQ ID NO: 9006 - protein, 75 aa, Homo sapiens
MTEYKLVVVGAGGVGKSALTIQLIQNHFVDEYDPTIEGVDDAFYTLVREIRKHKEKMSKDGKKKKKKSKTKCVIM

SEQ ID NO: 9007 - protein, 976 aa, Homo sapiens [sequence omitted]

SEQ ID NO: 9008 - protein, 972 aa, Homo sapiens
MRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNTKPEILTYDRLVNGMLQCVAAGFPEPTIDWYFCPGTEQRCSASVLPVDVQTLNSSGPPFGKLVVQSSIDSSAFKHNGTVECKAYNDVGKTSAYFNFAFKEQIHPHTLFTPLLIGFVIVAGMMCIIVMILTYKYLQKPMYEVQWKVVEEINGNNYVYIDPTQLPYDHKWEFPRNRLSFGKTLGAGAFGKVVEATAYGLIKSDAAMTVAVKMLKPSAHLTEREALMSELKVLSYLGNHMNIVNLLGACTIGGPTLVITEYCCYGDLLNFLRRKRDSFICSKQEDHAEAALYKNLLHSKESSCSDSTNEYMDMKPGVSYVVPTKADKRRSVRIGSYIERDVTPAIMEDDELALDLEDLLSFSYQVAKGMAFLASKNCIHRDLAARNILLTHGRITKICDFGLARDIKNDSNYVVKGNARLPVKWMAPESIFNCVYTFESDVWSYGIFLWELFSLGSSPYPGMPVDSKFYKMIKEGFRMLSPEHAPAEMYDIMKTCWDADPLKRPTFKQIVQLIEKQISESTNHIYSNLANCSPNRQKPVVDHSVRINSVGSTASSSQPLLVHDDV

SEQ ID NO: 9009 - protein, 413 aa, Homo sapiens
MRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKLQEKYNSWHHGDFNYERQATLTISSARVNDSGVFMCYANNTFGSANVTTTLEVVDKGFINIFPMINTTVFVNDGENVDLIVEYEAFPKPEHQQWIYMNRTFTDKWEDYPKSENESNIRYVSELHLTRLKGTEGGTYTFLVSNSDVNAAIAFNVYVNSKL

SEQ ID NO: 9010 - protein, 403 aa, Homo sapiens
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFITEPTRKLEPSVGYATFWKPQHRVLTSVFTK

SEQ ID NO: 9011 - protein, 373 aa, Homo sapiens
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFM

SEQ ID NO: 9012 - protein, 353 aa, Homo sapiens
MAAELAMGAELPSSPLAIEYVNDFDLMKFEVKKEPPEAERFCHRLPPGSLSSTPLSTPCSSVPSSPSFCAPSPGTGGGGGAGGGGGSSQAGGAPGPPSGGPGAVGGTSGKPALEDLYWMSGYQHHLNPEALNLTPEDAVEALIGSGHHGAHHGAHHPAAAAAYEAFRGPGFAGGGGADDMGAGHHHGAHHAAHHHHAAHHHHHHHHHHGGAGHGGGAGHHVRLEERFSDDQLVSMSVRELNRQLRGFSKEEVIRLKQKRRTLKNRGYAQSCRFKRVQQRHILESEKCQLQSQVEQLKLEVGRLAKERDLYKEKYEKLAGRGGPGSAGGAGFPREPSPPQAGPGGAKGTADFFL

SEQ ID NO: 9013 - protein, 323 aa, Homo sapiens
MAAELSMGPELPTSPLAMEYVNDFDLLKFDVKKEPLGRAERPGRPCTRLQPAGSVSSTPLSTPCSSVPSSPSFSPTEQKTHLEDLYWMASNYQQMNPEALNLTPEDAVEALIGSHPVPQPLQSFDSFRGAHHHHHHHHPHPHHAYPGAGVAHDELGPHAHPHHHHHHQASPPPSSAASPAQQLPTSHPGPGPHATASATAAGGNGSVEDRFSDDQLVSMSVRELNRHLRGFTKDEVIRLKQKRRTLKNRGYAQSCRYKRVQQKHHLENEKTQLIQQVEQLKQEVSRLARERDAYKVKCEKLANSGFREAGSTSDSPSSPEFFL

SEQ ID NO: 9014 - protein, 323 aa, Homo sapiens; identical to SEQ ID NO: 9013

SEQ ID NO: 9015 - protein, 410 aa, Homo sapiens
MAKRSRSEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 9016 - protein, 752 aa, Homo sapiens
MAKRSRSEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSQPGSFSSWSGSFLMDDNMSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 9017 - protein, 692 aa, Homo sapiens
MAKRSRSEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSQPGSFSSWSGSFLMDDNMSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSNCEWETVVYGKTEDQLIMTEQARRYLSTYTATSSTSRALIL

SEQ ID NO: 9018 - protein, 236 aa, Homo sapiens
MCVCAGCRAAPSRRGAGPLQVAGGWSEGADMDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSGKDLPEPSKRGPPHGWPKLCPCLRSGIGSSQALGPSPPLFG

SEQ ID NO: 9019 - protein, 364 aa, Homo sapiens
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSENEEIDVVTVEKRQSLGIRKPVTITVRADPLDPCMKHFHISIHQQQHNYAARFPPESCSQEEASERGPQEEVLERDAAGEKEDEEDEEIVSPPPVESEAAQSCHPKPVSSDTEDVTKRKNHNFLERKRRNDLRSRFLALRDQVPTLASCSKAPKVVILSKALEYLQALVGAEKRMATEKRQLRCRQQQLQKRIAYLTGY

SEQ ID NO: 9020 - protein, 394 aa, Homo sapiens
MCVCAGCRAAPSRRGAGPLQVAGGWSEGADMDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSENEEIDVVTVEKRQSLGIRKPVTITVRADPLDPCMKHFHISIHQQQHNYAARFPPESCSQEEASERGPQEEVLERDAAGEKEDEEDEEIVSPPPVESEAAQSCHPKPVSSDTEDVTKRKNHNFLERKRRNDLRSRFLALRDQVPTLASCSKAPKVVILSKALEYLQALVGAEKRMATEKRQLRCRQQQLQKRIAYLTGY

SEQ ID NO: 9021 - protein, 206 aa, Homo sapiens
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSGKDLPEPSKRGPPHGWPKLCPCLRSGIGSSQALGPSPPLFG

SEQ ID NO: 9022 - protein, 100 aa, Homo sapiens
MDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFS

SEQ ID NO: 9023 - protein, 213 aa, Homo sapiens
MPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 9024 - protein, 172 aa, Homo sapiens
MPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRVYTLKERCLQVVRSLVKPENYRRLDIVRSLYEDLEDHPNVQKDLERLTQERIAHQRMGD

SEQ ID NO: 9025 - protein, 131 aa, Homo sapiens
MPRRAENWDEAEVGAEEAGVEEYGPEEDSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 9026 - protein, 426 aa, Homo sapiens
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQVFERPYTLTVLLLHLSPEGNLCVIRPRHSRWTITVSVG

SEQ ID NO: 9027 - protein, 786 aa, Homo sapiens
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHRCFSFGIGEGTSTSLIKGIARASGGTSEFITGKDRMQSKALRTLKRSLQPVVEDVSLSWHLPPGLSAKMLSPEQTVIFRGQRLISYAQLTGRMPAAETTGEVCLKYTLQGKTFEDKVTFPLQPKPDVNLTIHRLAAKSLLQTKDMGLRETPASDKKDALNLSLESGVISSFTAFIAINKELNKPVQGPLAHRDVPRPILLGASAPLKIKCQSGFRKALHSDRPPSASQPRGELMCYKAKTFQMDDYSLCGLISHKDQHSPGFGENHLVQLIYHQNANGSWDLNEDLAKILGMSLEEIMAAQPAELVDSSGWATILAVIWLHSNGKDLKCEWELLERKAVAWMRAHAGSTMPSVVKAAITFLKSSVDPAIFAF

SEQ ID NO: 9028 - protein, 415 aa, Homo sapiens
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGHLMGDPSAMVSFYPNIPEDQPSNTCGEFIFLMDRSGSMQSPMSSQDTSQLRIQAAKETLILLLKSLPIGCYFNIYGFGSSYEACFPESVKYTQQTMEEALGRVKLMQADLGGTEILAPLQNIYRGPSIPGHPLQLFVFTDGEVTDTFSVIKEVRINRQKHR

SEQ ID NO: 9029 - protein, 786 aa, Homo sapiens; identical to SEQ ID NO: 9027

SEQ ID NO: 9030 - protein, 415 aa, Homo sapiens; identical to SEQ ID NO: 9028

SEQ ID NO: 9031 - protein, 766 aa, Homo sapiens [sequence omitted]

SEQ ID NO: 9032 - protein, 648 aa, Homo sapiens [sequence omitted]

SEQ ID NO: 9033 - protein, 668 aa, Homo sapiens
MEHIQGAWKTISNGFGFKDAVFDGSSCISPTIVQQFGYQRRASDDGKLTDPSKTSNTIRVFLPNKQRTVVNVRNGMSLHDCLMKALKVRGLQPECCAVFRLLHEHKGKKARLDWNTDAASLIGEELQVDFLDHVPLTTHNFARKTFLKLAFCDICQKFLLNGFRCQTCGYKFHEHCSTKVPTMCVDWSNIRQLLLFPNSTIGDSGVPALPSLTMRRMRESVSRMPVSSQHRYSTPHAFTFNTSSPSSEGSLSQRQRSTSTPNVHMVSTTLPVDSRMIENNNLSASPRAWSRRFCLRGRDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 9034 - protein, 433 aa, Homo sapiens
MCVDWSNIRQLFSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 9035 - protein, 567 aa, Homo sapiens
MMANSQILLRQATLSVFSCRTSKEQCKKARLDWNTDAASLIGEELQVDFLDHVPLTTHNFARKTFLKLAFCDICQKFLLNGFRCQTCGYKFHEHCSTKVPTMCVDWSNIRQLLLFPNSTIGDSGVPALPSLTMRRMRESVSRMPVSSQHRYSTPHAFTFNTSSPSSEGSLSQRQRSTSTPNVHMVSTTLPVDSRMIEDAIRSHSESASPSALSSSPNNLSPTGWSQPKTPVPAQRERAPVSGTQEKNKIRPRGQRDSSYYWEIEASEVMLSTRIGSGSFGTVYKGKWHGDVAVKILKVVDPTPEQFQAFRNEVAVLRKTRHVNILLFMGYMTKDNLAIVTQWCEGSSLYKHLHVQETKFQMFQLIDIARQTAQGMDYLHAKNIIHRDMKSNNIFLHEGLTVKIGDFGLATVKSRWSGSQQVEQPTGSVLWMAPEVIRMQDNNPFSFQSDVYSYGIVLYELMTGELPYSHINNRDQIIFMVGRGYASPDLSKLYKNCPKAMKRLVADCVKKVKEERPLFPQILSSIELLQHSLPKINRSASEPSLHRAAHTEDINACTLTTSPRLPVF

SEQ ID NO: 9036 - protein, 536 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 9037 - protein, 542 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTRKVDVREGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 9038 - protein, 536 aa, Homo sapiens; identical to SEQ ID NO: 9036

SEQ ID NO: 9039 - protein, 536 aa, Homo sapiens; identical to SEQ ID NO: 9036

SEQ ID NO: 9040 - protein, 536 aa, Homo sapiens; identical to SEQ ID NO: 9036

SEQ ID NO: 9041 - protein, 140 aa, Homo sapiens
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPY

SEQ ID NO: 9042 - protein, 559 aa, Homo sapiens
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQKQKNLDRPHEPEKVPRAPHDRRREWQKLAQGPELAEDDANLLHKHIEVANGPASHFETRPQTYVDHMDGSYSLSALPFSQMSELLTRAEERVLVRPHEPPPPPPMHGAGDAKPIPTCISSATGLIENRPQSPATGRTPVFVSPTPPPPPPPLPSALSTSSLRASMTSTPPPPVPPPPPPPATALQAPAVPPPPAPLQIAPGVLHPAPPPIAPPLVQPSPPVARAAPVCETVPVHPLPQGEVQGLPPPPPPPPLPPPGIRPSSPVTVTALAHPPSGLHPTPSTAPGPHVPLMPPSPPSQVIPASEPKRHPSTLPVISDARSVLLEAIRKGIQLRKVEEQREQEAKHERIENDVATILSRRIAVEYSDSEDDSEFDEVDWLE

SEQ ID NO: 9043 - protein, 140 aa, Homo sapiens; identical to SEQ ID NO: 9041

SEQ ID NO: 9044 - protein, 559 aa, Homo sapiens; identical to SEQ ID NO: 9042

SEQ ID NO: 9045 - protein, 559 aa, Homo sapiens; identical to SEQ ID NO: 9042

SEQ ID NO: 9046 - protein, 559 aa, Homo sapiens; identical to SEQ ID NO: 9042

SEQ ID NO: 9047 - protein, 559 aa, Homo sapiens; identical to SEQ ID NO: 9042

SEQ ID NO: 9048 - protein, 89 aa, Homo sapiens
MPLVKRNIDPRHLCHTALPRGIKNELECVTNISLANIIRQLSSLSKYAEDIFGELFNEAHSFSFRVNSLQERVDRLSVSVTQLDPKEEE

SEQ ID NO: 9049 - protein, 180 aa, Homo sapiens
MPLVKRNIDPRHLCHTALPRGIKNELECVTNISLANIIRQLSSLSKYAEDIFGELFNEAHSFSFRVNSLQERVDRLSVSVTQLDPKEEELSLQDITMRKAFRSSTIQDQQLFDRKTLPIPLQETYDVCEQPPPLNILTPYRDDGKEGLKFYTNPSYFFDLWKEKMLQDTEDKRKEKRKQK

SEQ ID NO: 9050 - protein, 89 aa, Homo sapiens; identical to SEQ ID NO: 9048

SEQ ID NO: 9051 - protein, 498 aa, Homo sapiens
MPLVTRNIEPRHLCRQTLPSVRSELECVTNITLANVIRQLGSLSKYAEDIFGELFTQANTFASRVSSLAERVDRLQVKVTQLDPKEEEVSLQGINTRKAFRSSTIQDQKLFDRNSLPVPVLETYNTCDTPPPLNNLTPYRDDGKEALKFYTDPSYFFDLWKEKMLQDTKDIMKEKRKHRKEKKDNPNRGNVNPRKIKTRKEEWEKMKMGQEFVESKEKLGTSGYPPTLVYQNGSIGCVENVDASSYPPPPQSDSASSPSPSFSEDNLPPPPAEFSYPVDNQRGSGLAGPKRSSVVSPSHPPPAPPLGSPPGPKPGFAPPPAPPPPPPPMIGIPPPPPPVGFGSPGTPPPPSPPSFPPHPDFAAPPPPPPPPAADYPTLPPPPLSQPTGGAPPPPPPPPPPGPPPPPFTGADGQPAIPPPLSDTTKPKSSLPAVSDARSDLLSAIRQGFQLRRVEEQREQEKRDVVGNDVATILSRRIAVEYSDSEDDSSEFDEDDWSD

SEQ ID NO: 9052 - protein, 281 aa, Homo sapiens
MPLVTRNIEPRHLCRQTLPSVRSELECVTNITLANVIRQLGSLSKYAEDIFGELFTQANTFASRVSSLAERVDRLQVKVTQLDPKEEEVSLQGINTRKAFRSSTIQDQKLFDRNSLPVPVLETYNTCDTPPPLNNLTPYRDDGKEALKFYTDPSYFFDLWKEKMLQDTKDIMKEKRKHRKEKKDNPNRGNVNPRKIKTRKEEWEKMKMGQEFVESKEKLGTSGYPPTLVYQNGSIGCVENVDASSYPPPPQSDSASSPSPSFSEDNLPPPPAEFRFSAAQG

SEQ ID NO: 9053 - protein, 510 aa, Homo sapiens
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPRPPKQAAE

SEQ ID NO: 9054 - protein, 503 aa, Homo sapiens
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 9055 - protein, 503 aa, Homo sapiens; identical to SEQ ID NO: 9054

SEQ ID NO: 9056 - protein, 503 aa, Homo sapiens; identical to SEQ ID NO: 9054

SEQ ID NO: 9057 - protein, 359 aa, Homo sapiens
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 9058 - protein, 493 aa, Homo sapiens
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSPHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSEYFCQGF

SEQ ID NO: 9059 - protein, 100 aa, Homo sapiens
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGL

SEQ ID NO: 9060 - protein, 548 aa, Homo sapiens
MKTLETQPLAPDCCPSDQDPAPAHPSPHASPMNKNADSELMPPPPERGDPPRLSPDPVAGSAVSQELREGDPVSLSTPLETEFGSPSELSPRIEEQELSENTSLPAEEANGSLSEEEANGPELGSGKAMEDTSGEPAAEDEGDTAWNYSFSQLPRFLSGSWSEFSTQPENFLKGCKWAPDGSCILTNSADNILRIYNLPPELYHEGEQVEYAEMVPVLRMVEGDTIYDYCWYSLMSSAQPDTSYVASSSRENPIHIWDAFTGELRASFRAYNHLDELTAAHSLCFSPDGSQLFCGFNRTVRVFSTARPGRDCEVRATFAKKQGQSGIISCIAFSPAQPLYACGSYGRSLGLYAWDDGSPLALLGGHQGGITHLCFHPDGNRFFSGARKDAELLCWDLRQSGYPLWSLGREVTTNQRIYFDLDPTGQFLVSGSTSGAVSVWDTDGPGNDGKPEPVLSFLPQKDCTNGVSLHPSLPLLATASGQRVFPEPTESGDEGEELGLPLLSTRHVHLECRLQLWWCGGAPDSSIPDDHQGEKGQGGTEGGVGELI

SEQ ID NO: 9061 - protein, 548 aa, Homo sapiens; identical to SEQ ID NO: 9060

SEQ ID NO: 9062 - protein, 548 aa, Homo sapiens; identical to SEQ ID NO: 9060

SEQ ID NO: 9063 - protein, 188 aa, Homo sapiens
MKTLETQPLAPDCCPSDQDPAPAQPDTSYVASSSRENPIHIWDAFTGELRASFRAYNHLDELTAAHSLCFSPDGSQLFCGFNRTVRVFSTARPGRDCEVRATFGKHLCLQGRRRGKGTATCTGAFCEPGATCGGSRRPLYGPGSRCSPVGRGANRLRAGRKPSQGQPAGQRTASFLNSYPVSCGAFGL

SEQ ID NO: 9064 - protein, 548 aa, Homo sapiens; identical to SEQ ID NO: 9060

SEQ ID NO: 9065 - protein, 432 aa, Homo sapiens
MDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAAEERALFTDRMATRSTTQSNRTSRLIGKKMNRSVSLTIY

SEQ ID NO: 9066 - protein, 646 aa, Homo sapiens
MSFLSRQQPPPPRRAGAACTLRQKLIFSPCSDCEEEEEEEEEEGSGHSTGEDSAFQEPDSPLPPARSPTEPGPERRRSPGPAPGSPGELEEDLLLPGACPGADEAGGGAEGDSWEEEGFGSSSPVKSPAAPYFLGSSFSPVRCGGPGDASPRGCGARRAGEGRRSPRPDHPGTPPHKTFRKLRLFDTPHTPKSLLSKARGIDSSSVKLRGSSLFMDTEKSGKREFDVRQTPQVNINPFTPDSLLLHSSGQCRRRKRTYWNDSCGEDMEASDYELEDETRPAKRITITESNMKSRYTTEFHELEKIGSGEFGSVFKCVKRLDGCIYAIKRSKKPLAGSVDEQNALREVYAHAVLGQHSHVVRYFSAWAEDDHMLIQNEYCNGGSLADAISENYRIMSYFKEAELKDLLLQVGRGLRYIHSMSLVHMDIKPSNIFISRTSIPNAASEEGDEDDWASNKVMFKIGDLGHVTRISSPQVEEGDSRFLANEVLQENYTHLPKADIFALALTVVCAAGAEPLPRNGDQWHEIRQGRLPRIPQVLSQEFTELLKVMIHPDPERRPSAMALVKHSVLLSASRKSAEQLRIELNAEKFKNSLLQKELKKAQMAKAAAEERALFTDRMATRSTTQSNRTSRLIGKKMNRSVSLTIY

SEQ ID NO: 9067 - protein, 517 aa, Homo sapiens
LQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 9068 - protein, 317 aa, Homo sapiens
LQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKG

SEQ ID NO: 9069 - protein, 302 aa, Homo sapiens
MEKGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 9070 - protein, 514 aa, Homo sapiens
LQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 9071 - protein, 497 aa, Homo sapiens
LQDPASTCVPEPASQHTLRSGPGCLQQPEQQGVRDPGGIWAKLGAAEASAERLQGRRSRGASGSEPQQMGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGEKPFSCRWPSCQKKFARSDELVRHHNMHQRNMTKLQLAL

SEQ ID NO: 9072 - protein, 131 aa, Homo sapiens
MGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVR

SEQ ID NO: 9073 - protein, 178 aa, Homo sapiens
  MOD_RES (1)..(1): Any amino acid
XLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGVKPFQCKTCQRKFSRSDHLKTHTRTHTGKTSEKPFSCRWPSCQKKFARSDELVRHHNMHQRNMTKLQLAL

SEQ ID NO: 9074 - protein, 288 aa, Homo sapiens
MEKGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 9075 - protein, 354 aa, Homo sapiens
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYALSAAAISHAIARACTSGDLPGCSCGPVPGEPPGPGNRWGGCADNLSYGLLMGAKFSDAPMKVKKTGSQANKLMRLHNSEVGRQALRASLEMKCKCHGVSGSCSIRTCWKGLQELQDVAADLKTRYLSATKVVHRPMGTRKHLVPKDLDIRPVKDSELVYLQSSPDFCMKNEKVGSHGTQDRQCNKTSNGSDSCDLMCCGRGYNPYTDRVVERCHCKYHWCCYVTCRRCERTVERYVCK

SEQ ID NO: 9076 - protein, 253 aa, Homo sapiens
MRARPQVCEALLFALALQTGVCYGIKWLALSKTPSALALNQTQHCKQLEGLVSAQVQLCRSNLELMHTVVHAAREVMKACRRAFADMRWNCSSIELAPNYLLDLERGTRESAFVYALSAAAISHAIARACTSGDLPGCSCGPVPGEPPGPGNRWGGCADNLSYGLLMGAKFSDAPMKVKKTGSQANKLMRLHNSEVGRQALRASLLVNSRCQAWEAACALPSLGSHQEQKVWPPWKEGRTSKETDKIKNNLAA

SEQ ID NO: 9077 - protein, 5 aa, Homo sapiens
MRARP

SEQ ID NO: 9078 - protein, 380 aa, Homo sapiens
MKKSIGILSPGVALGMAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 9079 - protein, 129 aa, Homo sapiens
MKKSIGILSPGVALGMAGSAMSSKFFLVALAIFFSFAQVVIEANSWWSLGMNNPVQMSQDVGGHGWLRAHVLRPWLRPVQDRADGALPLQVPLVLLRQVQEVHGDRGPVCVQVVGATQHSAPLPGPAYL

SEQ ID NO: 9080 - protein, 380 aa, Homo sapiens; identical to SEQ ID NO: 9078

SEQ ID NO: 9081 - protein, 214 aa, Homo sapiens
MAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRV

SEQ ID NO: 9082 - protein, 365 aa, Homo sapiens
MAGSAMSSKFFLVALAIFFSFAQVVIEANSWWSLGMNNPVQMSEVYIIGAQPLCSQLAGLSQGQKKLCHLYQDHMQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 9083 - protein, 291 aa, Homo sapiens
MQYIGEGAKTGIKECQYQFRHRRWNCSTVDNTSVFGRVMQIGSRETAFTYAVSAAGVVNAMSRACREGELSTCGCSRAARPKDLPRDWLWGGCGDNIDYGYRFAKEFVDARERERIHAKGSYESARILMNLHNNEAGRRTVYNLADVACKCHGVSGSCSLKTCWLQLADFRKVGDALKEKYDSAAAMRLNSRGKLVQVNSRFNSPTTQDLVYIDPSPDYCVRNESTGSLGTQGRLCNKTSEGMDGCELMCCGRGYDQFKTVQTERCHCKFHWCCYVKCKKCTEIVDQFVCK

SEQ ID NO: 9084 - protein, 359 aa, Homo sapiens
MPSLLLLFTAALLSSWAQLLTDANSWWSLALNPVQRPEMFIIGAQPVCSQLPGLSPGQRKLCQLYQEHMAYIGEGAKTGIKECQHQFRQRRWNCSTADNASVFGRVMQIGSRETAFTHAVSAAGVVNAISRACREGELSTCGCSRTARPKDLPRDWLWGGCGDNVEYGYRFAKEFVDAREREKNFAKGSEEQGRVLMNLQNNEAGRRAVYKMADVACKCHGVSGSCSLKTCWLQLAEFRKVGDRLKEKYDSAAAMRVTRKGRLELVNSRFTQPTPEDLVYVDPSPDYCLRNESTGSLGTQGRLCNKTSEGMDGCELMCCGRGYNQFKSVQVERCHCKFHWCCFVRCKKCTEIVDQYICK

SEQ ID NO: 9085 - protein, 359 aa, Homo sapiens; identical to SEQ ID NO: 9084

SEQ ID NO: 9086 - protein, 359 aa, Homo sapiens; identical to SEQ ID NO: 9084

SEQ ID NO: 9087 - protein, 505 aa, Homo sapiens
MSSVQQQPPPPRRVTNVGSLLLTPQENESLFTFLGKKCVTMSSAVVQLYAADRNCMWSKKCSGVACLVKDNPQRSYFLRIFDIKDGKLLWEQELYNNFVYNSPRGYFHTFAGDTCQVALNFANEEEAKKFRKAVTDLLGRRQRKSEKRRDPPNGPNLPMATVDIKNPEITTNRFYGPQVNNISHTKEKKKGKAKKKRLTKADIGTPSNFQHIGHVGWDPNTGFDLNNLDPELKNLFDMCGISEAQLKDRETSKVIYDFIEKTGGVEAVKNELRRQAPPPPPPSRGGPPPPPPPPHNSGPPPPPARGRGAPPPPPSRAPTAAPPPPPPSRPSVAVPPPPPNRMYPPPPPALPSSAPSGPPPPPPSVLGVGPVAPPPPPPPPPPPGPPPPPGLPSDGDHQVPTTAGNKAALLDQIREGAQLKKVEQNSRPVSCSGRDALLDQIRQGIQLKSVADGQESTPPTPAPTSGIVGALMEVMQKRSKAIHSSDEDEDEDDEEDFEDDDEWED

SEQ ID NO: 9088 - protein, 57 aa, Homo sapiens
MSSVQQQPPPPRRVTNVGSLLLTPQENESLFTFLGKKCVTMSSAVVQLYAADRNLSC

SEQ ID NO: 9089 - protein, 379 aa, Homo sapiens
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCICPPGLEGEQCEISKCPQPCRNGGKCIGKSKCKCSKGYQGDLCSKPVCEPGCGAHGTCHEPNKCQCQEGWHGRHCNKRYEASLIHALRPAGAQLRQHTPSLKKAEERRDPPESNYIW

SEQ ID NO: 9090 - protein, 39 aa, Homo sapiens
KKRKEKKREKRRGKERKELFKLVSHVLENRMGWQHLKWM

SEQ ID NO: 9091 - protein, 364 aa, Homo sapiens
MARASEAVSRILEEWHKAKVEAMTLDLALLRSVQHFAEAFKAKNVPLHVLVCNAATFALPWSLTKDGLETTFQVNHLGHFYLVQLLRMFCAAQLLPVSLWSPQSPIDLQILTTPWENWTSVASLQQKTTIGRCWLITGPSSATSSSPTSCTVAPTRGHVERSASWKYDVLQHSSQLVGVHTAVYLGEAFHQVHATGSCHHRVLCCCPRTGGSGRDVLQQLLPLHALTRSSERRDGPDPVGSERLIQERLASPAKWSSERMGTHTRPVCVPSRKCQGPLPNVPPTQIRKSKGNKSSHNRVKNLKYQWEAGNSWGKVSLFWGWARHRSLCFLVVACLKVKTCLVCRFRISLEKHQQFSFFYCYRIA

SEQ ID NO: 9092 - protein, 189 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWKTKYHPPPEKCRIKIFH

SEQ ID NO: 9093 - protein, 311 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIATGSCHHRVLCCCPRTGGSGRDVLQQLLPLHALTRSSERRDGPDPVGAQREADPRTAWQPVRLSGAQSGWAHTPALCVSPHASARAGPLPNVPPTQIRKSKGNKSSHNRVKNLKYQWEAGNSWGKVSLFWGWARHRSLCFLVVACLKVKTCLVCRFRISLEKHQQFSFFYCYRIA

SEQ ID NO: 9094 - protein, 234 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWQQGAATTVYCAAVPELEGLGGMYFNNCCRCMPSPEAQSEETARTLWALSERLIQERLGSQSG

SEQ ID NO: 9095 - protein, 414 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGFETAKSFALHGAHVILACRNMARASEAVSRILEEWHKAKVEAMTLDLALLRSVQHFAEAFKAKNVPLHVLVCNAATFALPWSLTKDGLETTFQVNHLGHFYLVQLLQDVLCRSAPARVIVVSSESHRFTDINDSLGKLDFSRLSPTKNDYWAMLAYNRSKLCNILFSNELHRRLSPRGVTSNAVHPGNMMYSNIHRSWWVYTLLFTLARPFTKSMQQGAATTVYCAAVPELEGLGGMYFNNCCRCMPSPEAQSEETARTLWALSERLIQERLGSQSG

SEQ ID NO: 9096 - protein, 213 aa, Homo sapiens
MAALRYAGLDDTDSEDELPPGWEERTTKDGWVYYANHTEEKTQWEHPKTGKRKRVAGDLPYGWEQETDENGQVFFVDHINKRTTYLDPRLAFTVDDNPTKPTTRQRYDGSTTAMEILQGRDFTGKVVVVTGANSGIGKASCHVGRILKHTRVEELSLLPTAINRELPPPCTVLLSQNWRVWEGCTSTTAAAACPHQKLRAKRRPGPCGRSARG

SEQ ID NO: 9097 - protein, 414 aa, Homo sapiens; identical to SEQ ID NO: 9095

SEQ ID NO: 9098 - protein, 36 aa, Homo sapiens
MAALRYAGLDDTDSEDELPPGWEERTTKDGWVYYAK

SEQ ID NO: 9099 - protein, 261 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 9100 - protein, 376 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAAGAGPVVTPPEHLPMDSGGIDSSDSESDILLGILDNLDPVMFFKCPSPEPASLEELPEVYPEGPSSLPASLSLSVGTSSAKLEAINELIRFDHIYTKPLVLEIPSETESQANVVVKIEEAPLSPSENDHPEFIVSVKEEPVEDDLVPELGISNLLSSSHCPKPSSCLLDAYSDCGYGGSLSPFSDMSSLLGVNHSWEDTFANELFPQLISV

SEQ ID NO: 9101 - protein, 266 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEEVKLLKNQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 9102 - protein, 211 aa, Homo sapiens
MRAPVFQALLLCGRRLVVQPLNSDMRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 9103 - protein, 273 aa, Homo sapiens
MAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKELRRAVRSSVWKRETIVHQHEYGPEENLEDDMYRKTCTMCGHELTYEKM

SEQ ID NO: 9104 - protein, 940 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEELSEPVLGDVRESTAFSRSLLPVKPVEIEIETPEQAKTRERSEKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQRKAPAPQRTKAGSKSASRTHRGSHRKDPSLPAASSSSSSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEFQAKHMDQPLPTAIGLYKNHPLYALKRHLLKYEAIYPETAAILGYCRGEAVYSRDCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEQL

SEQ ID NO: 9105 - protein, 903 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEAKTRERSEKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQRKAPAPQRTKAGSKSASRTHRGSHRKDPSLPAASSSSSSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEFQAKHMDQPLPTAIGLYKNHPLYALKRHLLKYEAIYPETAAILGYCRGEAVYSRDCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEQL

SEQ ID NO: 9106 - protein, 140 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEVKR

SEQ ID NO: 9107 - protein, 168 aa, Homo sapiens
MARKRAAGGEPRGRELRSQKSKAKSKARHAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEELSEPVLGDVRESTAFSRSLLPVKPVEIEIETPEQAK

SEQ ID NO: 9108 - protein, 153 aa, Homo sapiens
SSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEGLCAHSAFQGHVAEESKSGEAWRSTLQDGERLF

SEQ ID NO: 9109 - protein, 58 aa, Homo sapiens
MCSDGEKAEKRSIAGIDQWLEVFCEQEEKWVCVDCRCGGPASDLLQVRHQAHDLCGGH

SEQ ID NO: 9110 - protein, 76 aa, Homo sapiens
KATQRRPHGRERRVASRVSYKEESGSDEAGSGSDFELSSGEASDPSDEDSEPGPPKQRKAPAPQRTKAGSKSASRT

SEQ ID NO: 9111 - protein, 282 aa, Homo sapiens
MEGDFSVCRNCKRHVVSANFTLHEAYCLRFLVLCPECEEPVPKETMEEHCKLEHQQANECQERPVECKFCKLDMQLSKLELHESYCGSRTELCQGCGQFIMHRMLAQHRDVCRSEQAQLGKGERISAPEREIYCHYCNQMIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKGKQVRNFS

SEQ ID NO: 9112 - protein, 301 aa, Homo sapiens
MEGDFSVCRNCKRHVVSANFTLHEAYCLRFLVLCPECEEPVPKETMEEHCKLEHQQVGCTMCQQSMQKSSLEFHKANECQERPVECKFCKLDMQLSKLELHESYCGSRTELCQGCGQFIMHRMLAQHRDVCRSEQAQLGKGERISAPEREIYCHYCNQMIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKGKQVRNFS

SEQ ID NO: 9113 - protein, 199 aa, Homo sapiens
MSLHYGCCCPECTSVAIKEMMWVIRPRVACVVKDAGSAGERISAPEREIYCHYCNQMIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKGKQVRNFS

SEQ ID NO: 9114 - protein, 164 aa, Homo sapiens
MEGDFSVCRNCKRHVVSANFTLHEAYCLRFLVLCPECEEPVPKETMEEHCKLEHQQVGCTMCQQSMQKSSLEFHKANECQERPVECKFCKLDMQLSKLELHESYCGSRTELCQGCGQFIMHRMLAQHRDVCRSEQAQLGKETSPDPGKCLSITVAAALSAHLWP

SEQ ID NO: 9115 - protein, 301 aa, Homo sapiens
MEGDFSVCRNCKRHVVSANFTLHEAYCLRFLVLCPECEEPVPKETMEEHCKLEHQQVSEMGSGRGKCSILPARKKANECQERPVECKFCKLDMQLSKLELHESYCGSRTELCQGCGQFIMHRMLAQHRDVCRSEQAQLGKGERISAPEREIYCHYCNQMIPENKYFHHMGKCCPDSEFKKHFPVGNPEILPSSLPSQAAENQTSTMEKDVRPKTRSINRFPLHSESSSKKAPRSKNKTLDPLLMSEPKPRTSSPRGDKAAYDILRRCSQCGILLPLPILNQHQEKCRWLASSKGKQVRNFS

SEQ ID NO: 9116 - protein, 497 aa, Homo sapiens
MTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPRNPAMYSEEARLKSFQNWPDYAHLTPRELASAGLYYTGIGDQVQCFCCGGKLKNWEPCDRAWSEHRRHFPNCFFVLGRNLNIRSESDAVSSDRNFPNSTNLPRNPSMADYEARIFTFGTWIYSVNKEQLARAGFYALGEGDKVKCFHCGGGLTDWKPSEDPWEQHAKWYPGCKYLLEQKGQEYINNIHLTHSLEECLVRTTEKTPSLTRRIDDTIFQNPMVQEAIRMGFSFKDIKKIMEEKIQISGSNYKSLEVLVADLVNAQKDSMQDESSQTSLQKEISTEEQLRRLQEEKLCKICMDRNIAIVFVPCGHLVTCKQCAEAVDKCPMCYTVITFKQKIFMS

SEQ ID NO: 9117 - protein, 497 aa, Homo sapiens; identical to SEQ ID NO: 9116

SEQ ID NO: 9118 - protein, 16 aa, Homo sapiens
MTFNSFEGSKTCVPAD

SEQ ID NO: 9119 - protein, 156 aa, Homo sapiens
MTFNSFEGSKTCVPADINKEEEFVEEFNRLKTFANFPSGSPVSASTLARAGFLYTGEGDTVRCFSCHAAVDRWQYGDSAVGRHRKVSPNCRFINGFYLENSATQSTNSGIQNGQYKVENYLGSRDHFALDRPSETHADYLLRTGQVVDISDTIYPR

SEQ ID NO: 9120 - protein, 497 aa, Homo sapiens; identical to SEQ ID NO: 9116

SEQ ID NO: 9121 - protein, 855 aa, Homo sapiens
MVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQLGKLWCSLADYYIRSGHFEKARDVYEEAIRTVMTVRDFTQVFDSYAQFEESMIAAKMETASELGREEEDDVDLELRLARFEQLISRRPLLLNSVLLRQNPHHVHEWHKRVALHQGRPREIINTYTEAVQTVDPFKATGKPHTLWVAFAKFYEDNGQLDDARVILEKATKVNFKQVDDLASVWCQCGELELRHENYDEALRLLRKATALPARRAEYFDGSEPVQNRVYKSLKVWSMLADLEESLGTFQSTKAVYDRILDLRIATPQIVINYAMFLEEHKYFEESFKAYERGISLFKWPNVSDIWSTYLTKFIARYGGRKLERARDLFEQALDGCPPKYAKTLYLLYAQLEEEWGLARHAMAVYERATRAVEPAQQYDMFNIYIKRAAEIYGVTHTRGIYQKAIEVLSDEHAREMCLRFADMECKLGEIDRARAIYSFCSQICDPRTTGAFWQTWKDFEVRHGNEDTIKEMLRIRRSVQATYNTQVNFMASQMLKVSGSATGTVSDLAPGQSGMDDMKLLEQRAEQLAAEAERDQPLRAQSKILFVRSDASREELAELAQQVNPEEIQLGEDEDEDEMDLEPNEVRLEQQSVPAAVFGSLKED

SEQ ID NO: 9122 - protein, 852 aa, Homo sapiens [sequence omitted]

SEQ ID NO: 9123 - protein, 633 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDNMSDRVQFVITAQEWDPSFEEALMDNPSLAFVRPRWIYSCNEKQKLLPHQLYGVVPQA

SEQ ID NO: 9124 - protein, 647 aa, Homo sapiens
STSSFWPGEAHDVDMPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDNMSDRVQFVITAQEWDPSFEEALMDNPSLAFVRPRWIYSCNEKQKLLPHQLYGVVPQA

SEQ ID NO: 9125 - protein, 400 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKLPQKVPPQHTPDQNQAHSGSWTQLTPEAPNP

SEQ ID NO: 9126 - protein, 602 aa, Homo sapiens
MPEIRLRHVVSCSSQDSLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSQRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDNMSDRVQFVITAQEWDPSFEEALMDNPSLAFVRPRWIYSCNEKQKLLPHQLYGVVPQA

SEQ ID NO: 9127 - protein, 280 aa, Homo sapiens
MCSAFHRAESGTELLARLEGRSSLKEIEPNLFADEDSPVHGDILEFHGPEGTGKTEMLYHLTARCILPKSEGGLEVEVLFIDTDYHFDMLRLVTILEHRLSQSSEEIIKYCLGRFFLVYCSSSTHLLLTLYSLESMFCSHPSLCLLILDSLSAFYWIDRVNGGESVNLQESTLRKCSQCLEKLVNDYRLVLFATTQTIMQKASSSSEEPSHASRRLCDVDIDYRPYLCKAWQQLVKHRMFFSKQDDSQSSNQFSLVSRCLKSNSLKKHFFIIGESGVEFC

SEQ ID NO: 9128 - protein, 346 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAGKTQLALQLCLAVQFPRQHGGLEAGAVYICTEDAFPHKRLQQLMAQQPRLRTDVPGELLQKLRFGSQIFIEHVADVDTLLECVNKKVPVLLSRGMARLVVIDSVAAPFRCEFDSQASAPRARHLQSLGATLRELSSAFQSPVLCINQVTEAMEEQGAAHGPLGFWDERVSPALGITWANQLLVRLLADRLREEEAALGCPARTLRVLSAPHLPPSSCSYTISAEGVRGTPGTQSH

SEQ ID NO: 9129 - protein, 346 aa, Homo sapiens; identical to SEQ ID NO: 9128

SEQ ID NO: 9130 - protein, 346 aa, Homo sapiens; identical to SEQ ID NO: 9128

SEQ ID NO: 9131 - protein, 47 aa, Homo sapiens
MDLDLLDLNPRIIAAIKKAKLKSVKEVLHFSGPDLKRLTNLSSPEVW

SEQ ID NO: 9132 - protein, 45 aa, Homo sapiens
MDLDLLDLNPRIIAAIKKAKLKSVKEVLHFSGPDLKRLTNLSSPE

SEQ ID NO: 9133 - protein, 346 aa, Homo sapiens; identical to SEQ ID NO: 9128

SEQ ID NO: 9134 - protein, 346 aa, Homo sapiens; identical to SEQ ID NO: 9128

SEQ ID NO: 9135 - protein, 102 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGI

SEQ ID NO: 9136 - protein, 61 aa, Homo sapiens
MDLDLLDLNPRIIAAIKKAKLKSVKEVLHFSGPDLKRLTNLSSPEVWHLLRTASLHLRGSS

SEQ ID NO: 9137 - protein, 112 aa, Homo sapiens
MDLDLLDLNPRIIAAIKKAKLKSVKEVLHFSGPDLKRLTNLSSPEVWHLLRTASLHLRGSSILTALQLHQQKERFPTQHQRLSLGCPVLDALLRGGLPLDGITELAGRSSAG

SEQ ID NO: 9138 - protein, 334 aa, Homo sapiens
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKEKPDSSLPETSKKEHISAENMSLETLRNSSPEDLFDEI

SEQ ID NO: 9139 - protein, 336 aa, Homo sapiens
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKENSRPDSSLPETSKKEHISAENMSLETLRNSSPEDLFDEI

SEQ ID NO: 9140 - protein, 334 aa, Homo sapiens; identical to SEQ ID NO: 9138

SEQ ID NO: 9141 - protein, 336 aa, Homo sapiens; identical to SEQ ID NO: 9139

SEQ ID NO: 9142 - protein, 61 aa, Homo sapiens
MQRNLGTEPKMAPQENQLQEKENSRPDSSLPETSKKEHISAENMSLETLRNSSPEDLFVSI

SEQ ID NO: 9143 - protein, 732 aa, Homo sapiens
MVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITKEEASGSSVTAEEAKKFLAPKDKPSGDTAAVFEEGGDVDDLLDMI

SEQ ID NO: 9144 - protein, 732 aa, Homo sapiens; identical to SEQ ID NO: 9143

SEQ ID NO: 9145 - protein, 609 aa, Homo sapiens
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 9146 - protein, 609 aa, Homo sapiens; identical to SEQ ID NO: 9145

SEQ ID NO: 9147 - protein, 557 aa, Homo sapiens
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHAKGPRWSIQKRS

SEQ ID NO: 9148 - protein, 568 aa, Homo sapiens
MSGWESYYKTEGDEEAEEEQEENLEASGDYKYSGRDSLIFLVDASKAMFESQSEDELTPFDMSIQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 9149 - protein, 559 aa, Homo sapiens
MKKQRKNKKRTLKQVCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 9150 - protein, 609 aa, Homo sapiens; identical to SEQ ID NO: 9145

SEQ ID NO: 9151 - protein, 476 aa, Homo sapiens [sequence omitted]

SEQ ID NO: 9152 - protein, 246 aa, Homo sapiens
MAGAPDERRRGPAAGEQLQQQHVSCQVFPERLAQGNPQQGFFSSFFTSNQKCQLRLLKTLETNPYVKLLLDAMKHSGCAVNKDRHFSCEDCNGNVSGGFDASTSQIVLCQNNIHNQAHMNRVVTHELIHAFDHCRAHVDWFTNIRHLACSEVRAANLSGDCSLVNEIFRLHFGLKQHHQTCVRDRATLSILAVRNISKEVAKKAVDEVFESCFNDHEPFGRIPHNKTYARYAHRDFENRDRYYSNI

SEQ ID NO: 9153 - protein, 504 aa, Homo sapiens
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 9154 - protein, 454 aa, Homo sapiens
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASAMNQRISQSAPVKQPPPLAPQSPQGGVMGGSNSNQQQQMRLQQLQMEKERLRLKQQELLRQVRPQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 9155 - protein, 421 aa, Homo sapiens
MRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFGKAMNQRISQSAPVKQPPPLAPQSPQGGVMGGSNSNQQQQMRLQQLQMEKERLRLKQQELLRQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 9156 - protein, 326 aa, Homo sapiens
MAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQAMRNINPSTANSPKCQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 9157 - protein, 488 aa, Homo sapiens
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 9158 - protein, 492 aa, Homo sapiens
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASGPLPDGWEQAMTQDGEIYYINHKNKTTSWLDPRLDPRFAMNQRISQSAPVKQPPPLAPQSPQGGVMGGSNSNQQQQMRLQQLQMEKERLRLKQQELLRQVRPQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 9159 - protein, 450 aa, Homo sapiens
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASAMNQRISQSAPVKQPPPLAPQSPQGGVMGGSNSNQQQQMRLQQLQMEKERLRLKQQELLRQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 9160 - protein, 619 aa, Homo sapiens
MANDIDELIGIPFPNHSSEVLCSLNEQRHDGLLCDVLLVVQEQEYRTHRSVLAACSKYFKKLFTAGTLASQPYVYEIDFVQPEALAAILEFAYTSTLTITAGNVKHILNAARMLEIQCIVNVCLEIMEPGGDGGEEDDKEDDDDDEDDDDEEDEEEEEEEEEDDDDDTEDFADQENLPDPQDISCHQSPSKTDHLTEKAYSDTPRDFPDSFQAGSPGHLGVIRDFSIESLLRENLYPKANIPDRRPSLSPFAPDFFPHLWPGDFGAFAQLPEQPMDSGPLDLVIKNRKIKEEEKEELPPPPPPPFPNDFFKDMFPDLPGGPLGPIKAENDYGAYLNFLSATHLGGLFPPWPLVEERKLKPKASQQCPICHKVIMGAGKLPRHMRTHTGEKPYMCTICEVRFTRQDKLKIHMRKHTGERPYLCIHCNAKFVHNYDLKNHMRIHTGVRPYQCEFCYKSFTRSDHLHRHIKRQSCRMARPRRGRKPAAWRAASLLFGPGGPAPDKAAFVMPPALGEVGGHLGGAAVCLPGPSPAKHFLAAPKGALSLQELERQFEETQMKLFGRAQLEAERNAGGLLAFALAENVAAARPYFPLPDPWAAGLAGLPGLAGLNHVASMSEANN

SEQ ID NO: 9161 - protein, 619 aa, Homo sapiens; identical to SEQ ID NO: 9160

SEQ ID NO: 9162 - protein, 25 aa, Homo sapiens
MANDIDELIGIPFPNHSSEVLCSLN

SEQ ID NO: 9163 - protein, 18 aa, Homo sapiens
MANDIDELIGIPFPNHSS

SEQ ID NO: 9164 - protein, 1124 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 9165 - protein, 1125 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 9166 - protein, 289 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHIS

SEQ ID NO: 9167 - protein, 906 aa, Homo sapiens
MTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 9168 - protein, 1108 aa, Homo sapiens
MKVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 9169 - protein, 1059 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKHKKKK

SEQ ID NO: 9170 - protein, 643 aa, Homo sapiens
MADGPRCKRRKQANPRRNNGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGEEAKTEGLMKDDRAESQASSLGQKVGESSEQVSEEKTNEA

SEQ ID NO: 9171 - protein, 1057 aa, Homo sapiens
MADGPRCKRRKQANPRRNNGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 9172 - protein, 1015 aa, Homo sapiens
MMNASQMQKMSKTMILMLKSFYNNKTLLSFFLRHLKRTRGRAHQKPVVMMKMEHQMHFHNYSPVHIVIGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 9173 - protein, 1119 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSSLPEQCLFCPGRTLELVLKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 9174 - protein, 277 aa, Homo sapiens
MKVTNYNTVVETNSDSDDEDKLHIVEEESVTDAADCEGVPEDDLPTDQTVLPGRSSEREGNAKNCWEDDTGKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCI

SEQ ID NO: 9175 - protein, 1104 aa, Homo sapiens
MADGPRCKRRKQANPRRNNVTNYNTVVETNSDSDDEDKLHIVEEESVTDAADCEGVPEDDLPTDQTVLPGRSSEREGNAKNCWEDDIKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 9176 - protein, 1214 aa, Homo sapiens
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 9177 - protein, 424 aa, Homo sapiens
MADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKSGRAQWLTPLIPALLEAEVGRSRGQKIETLLANMVEPRLY

SEQ ID NO: 9178 - protein, 439 aa, Homo sapiens
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHL

SEQ ID NO: 9179 - protein, 135 aa, Homo sapiens
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTG

SEQ ID NO: 9180 - protein, 1214 aa, Homo sapiens; identical to SEQ ID NO: 9176

SEQ ID NO: 9181 - protein, 702 aa, Homo sapiens
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSN

SEQ ID NO: 9182 - protein, 91 aa, Homo sapiens
MKQPIMADGPRCKRRKQANPRRKNVVNYDNVVDTGSETDEEDKLHIAEDDGIANPLDQETSPASVPNHESSPHVSQALLPREEEEDEIREG

SEQ ID NO: 9183 - protein, 63 aa, Homo sapiens
MKQPIMADGPRCKRRKQANPRRKNVVNYDNVVDTGSETDEEDKLHIAEDDGIANPLDQETSPA

SEQ ID NO: 9184 - protein, 1190 aa, Homo sapiens
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 9185 - protein, 1214 aa, Homo sapiens; identical to SEQ ID NO: 9176

SEQ ID NO: 9186 - protein, 630 aa, Homo sapiens
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9187 - protein, 468 aa, Homo sapiens
MTTEDYKKLAPYNIRRSSTSGDTEEEEEEEVVPFSSDEQKRSSPTQETQAPFIAKRVEVVEEDGPSEKSQDPPALARSTPGSNRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9188 - protein, 457 aa, Homo sapiens
MTTEDYKKLAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSSRGEEIVRLQILTPRAGLRLVAPDVEGMSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9189 - protein, 689 aa, Homo sapiens
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNSADGGRTKASRAIWIECLPSMPSPAGSQELSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9190 - protein, 452 aa, Homo sapiens
MQRQAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSSRGEEIVRLQILTPRAGLRLVAPDVEGMSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9191 - protein, 475 aa, Homo sapiens
  MOD_RES (1)..(1): Any amino acid
XRSSTSGDTEEEEEEEVVPFSSDEQKRSLRRTAPREHSYVLSAAKKSTGSPTQETQAPFIAKRVEVVEEDGPSEKSQDPPALARSTPGSNRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9192 - protein, 381 aa, Homo sapiens
MTTEDYKKLAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSADGGRTKASRAIWIECLPSMPSPAGSQELSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGPSCTHSATCRSQYPRTAEQPQRI

SEQ ID NO: 9193 - protein, 211 aa, Homo sapiens
EEAFRAPNTDAARSSAQLSDGNVGSGATGSRPEGLAAVDIGSERGRLCAAASFASFLEDQDGHSANSQSCKPRPAAISSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQ

SEQ ID NO: 9194 - protein, 221 aa, Homo sapiens
  MOD_RES (1)..(1): Any amino acid
XLRRTAPREHSYVLSAAKKSTGSPTQETQAPFIAKRVEVVEEDGPSEKSQDPPALARSTPGSNSADGGRTKASRAIWIECLPSMPSPAGSQELSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKG

SEQ ID NO: 9195 - protein, 137 aa, Homo sapiens
  MOD_RES (1)..(1): Any amino acid
XVLPRRHRHRLSRRGWRWWKRTGLLRRARTHLLWQDPLLAQTVRMEAGPKRLGQFGSSACQVCLAPLGARSSGLPQATKTRRPPAPESSRGTWLVRRLSGPPTQMLQAPVPLQSLLSLLIGRATAQQPRRMQRQTQR

SEQ ID NO: 9196 - protein, 690 aa, Homo sapiens
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGSPTQETQAPFIAKRVEVVEEDGPSEKSQDPPALARSTPGSNSADGGRTKASRAIWIECLPSMPSPAGSQELSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9197 - protein, 330 aa, Homo sapiens
  MOD_RES (1)..(1): Any amino acid
XSEMAARDELGLGGDSLEAMPVPAARGRPRITNGPEELAAPSPAALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9198 - protein, 524 aa, Homo sapiens
MTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGSSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9199 - protein, 721 aa, Homo sapiens
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNSADGGRTKASRAIWIECLPSMPSPAGSQELSSRGEEIVRLQILTPRAGLRLVAPDVEGMRSSPGNKDKEAPCSRELQRDLAGEEAFRAPNTDAARSSAQLSDGNVGSGATGSRPEGLAAVDIGSERGRLCAAASFASFLEDQDGHSANSQSCKPRPAAISSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9200 - protein, 692 aa, Homo sapiens
MSISALGGRTKGKPLPPGEEERNNVLKQMKVRTTLKGDKSWITKQDESEGRTIELPSGRSRATSFSSAGEVPKPRPPSTRAPTGYIIRGVFTKPIDSSSQPQQQFPKANGTPKSAASLVRTANAGPPRPSSSGYKMTTEDYKKLAPYNIRRSSTSGDTEEEEEEEVVPFSSDEQKRRSEAASGVLRRTAPREHSYVLSAAKKSTGPTQETQAPFIAKRVEVVEEDGPSEKSQDPPALARSTPGSNSADGGRTKASRAIWIECLPSMPSPAGSQELRSSPGNKDKEAPCSRELQRDLAGEEAFRAPNTDAARSSAQLSDGNVGSGATGSRPEGLAAVDIGSERGRLCAAASFASFLEDQDGHSANSQSCKPRPAAISSSATSVSAVPADRKSNSTAAQEDAKADPKGALADYEGKDVATRVGEAWQERPGAPRGGQGDPAVPAQQPADPSTPERQSSPSGSEQLVRRESCGSSVLTDFEGKDVATKVGEAWQDRPGAPRGGQGDPAVPTQQPADPSTPEQQNSPSGSEQFVRRESCTSRVRSPSSCMVTVTVTATSEQPHIYIPAPASELDSSSTTKGILFVKEYVNASEVSSGKPVSARYSNVSSIEDSFAMEKKPPCGSTPYSERTTGGICTYCNREIRDCPKITLEHLGICCHEYCFKCGICSKPMGDLLDQIFIHRDTIHCGKCYEKLF

SEQ ID NO: 9201 - protein, 632 aa, Homo sapiens
MQREEGFNTKMADGPDEYDTEAGCVPLLHPEEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLNIDSWLIKGLMYGGVWATVQFLSKSFFDHSMHSALPLGIYLATKFWMYVTWFFWFWNDLNFLFIHLPFLANSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 9202 - protein, 216 aa, Homo sapiens
MSTIPKRAVCPFSTQRYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKAILRCHMAL

SEQ ID NO: 9203 - protein, 632 aa, Homo sapiens; identical to SEQ ID NO: 9201

SEQ ID NO: 9204 - DNA, 2667 bp, Artificial Sequence
  Description of Artificial Sequence: Synthetic coding sequence
atgctgagcagactgttcagaatgcacggcctgttcgtggccagccacccctgggaggtgatcgtgggcaccgtgaccctgaccatctgcatgatgagcatgaacatgttcaccggcaacaacaagatctgcggctggaactacgagtgccccaagttcgaggaggacgtgctgagcagcgacatcatcatcctgaccatcaccagatgcatcgccatcctgtacatctacttccagttccagaacctgagacagctgggcagcaagtacatcctgggcatcgccggcctgttcaccatcttcagcagcttcgtgttcagcaccgtggtgatccacttcctggacaaggagctgaccggcctgaacgaggccctgcccttcttcctgctgctgatcgacctgagcagagccagcaccctggccaagttcgccctgagcagcaacagccaggacgaggtgagagagaacatcgccagaggcatggccatcctgggccccaccttcaccctggacgccctggtggagtgcctggtgatcggcgtgggcaccatgagcggcgtgagacagctggagatcatgtgctgcttcggctgcatgagcgtgctggccaactacttcgtgttcatgaccttcttccccgcctgcgtgagcctggtgctggagctgagcagagagagcagagagggcagacccatctggcagctgagccacttcgccagagtgctggaggaggaggagaacaagcccaaccccgtgacccagagagtgaagatgatcatgagcctgggcctggtgctggtgcacgcccacagcagatggatcgccgaccccagcccccagaacagcaccgccgacaccagcaaggtgagcctgggcctggacgagaacgtgagcaagagaatcgagcccagcgtgagcctgtggcagttctacctgagcaagatgatcagcatggacatcgagcaggtgatcaccctgagcctggccctgctgctggccgtgaagtacatcttcttcgagcagaccgagaccgagagcaccctgagcctgaagaaccccatcaccagccccgtggtgacccagaagaaggtgcccgacaactgctgcagaagagagcccatgctggtgagaaacaaccagaagtgcgacagcgtggaggaggagaccggcatcaacagagagagaaaggtggaggtgatcaagcccctggtggccgagaccgacacccccaacagagccaccttcgtggtgggcaacagcagcctgctggacaccagcagcgtgctggtgacccaggagcccgagatcgagctgcccagagagcccagacccaacgaggagtgcctgcagatcctgggcaacgccgagaagggcgccaagttcctgagcgacgccgagatcatccagctggtgaacgccaagcacatccccgcctacaagctggagaccctgatggagacccacgagagaggcgtgagcatcagaagacagctgctgagcaagaagctgagcgagcccagcagcctgcagtacctgccctacagagactacaactacagcctggtgatgggcgcctgctgcgagaacgtgatcggctacatgcccatccccgtgggcgtggccggccccctgtgcctggacgagaaggagttccaggtgcccatggccaccaccgagggctgcctggtggccagcaccaacagaggctgcagagccatcggcctgggcggcggcgccagcagcagagtgctggccgacggcatgaccagaggccccgtggtgagactgcccagagcctgcgacagcgccgaggtgaaggcctggctggagaccagcgagggcttcgccgtgatcaaggaggccttcgacagcaccagcagattcgccagactgcagaagctgcacaccagcatcgccggcagaaacctgtacatcagattccagagcagaagcggcgacgccatgggcatgaacatgatcagcaagggcaccgagaaggccctgagcaagctgcacgagtacttccccgagatgcagatcctggccgtgagcggcaactactgcaccgacaagaagcccgccgccatcaactggatcgagggcagaggcaagagcgtggtgtgcgaggccgtgatccccgccaaggtggtgagagaggtgctgaagaccaccaccgaggccatgatcgaggtgaacatcaacaagaacctggtgggcagcgccatggccggcagcatcggcggctacaacgcccacgccgccaacatcgtgaccgccatctacatcgcctgcggccaggacgccgcccagaacgtgggcagcagcaactgcatcaccctgatggaggccagcggccccaccaacgaggacctgtacatcagctgcaccatgcccagcatcgagatcggcaccgtgggcggcggcaccaacctgctgccccagcaggcctgcctgcagatgctgggcgtgcagggcgcctgcaaggacaaccccggcgagaacgccagacagctggccagaatcgtgtgcggcaccgtgatggccggcgagctgagcctgatggccgccctggccgccggccacctggtgaagagccacatgatccacaacagaagcaagatcaacctgcaggacctgcagggcgcctgcaccaagaagaccgcctag

SEQ ID NO: 9205 - DNA, 2508 bp, Artificial Sequence
  Description of Artificial Sequence: Synthetic coding sequence
atgctgagcagactgttcagaatgcacggcctgttcgtggccagccacccctgggaggtgatcgtgggcaccgtgaccctgaccatctgcatgatgagcatgaacatgttcaccggcaacaacaagatctgcggctggaactacgagtgccccaagttcgaggaggacgtgctgagcagcgacatcatcatcctgaccatcaccagatgcatcgccatcctgtacatctacttccagttccagaacctgagacagctgggcagcaagtacatcctgggcatcgccggcctgttcaccatcttcagcagcttcgtgttcagcaccgtggtgatccacttcctggacaaggagctgaccggcctgaacgaggccctgcccttcttcctgctgctgatcgacctgagcagagccagcaccctggccaagttcgccctgagcagcaacagccaggacgaggtgagagagaacatcgccagaggcatggccatcctgggccccaccttcaccctggacgccctggtggagtgcctggtgatcggcgtgggcaccatgagcggcgtgagacagctggagatcatgtgctgcttcggctgcatgagcgtgctggccaactacttcgtgttcatgaccttcttccccgcctgcgtgagcctggtgctggagctgagcagagagagcagagagggcagacccatctggcagctgagccacttcgccagagtgctggaggaggaggagaacaagcccaaccccgtgacccagagagtgaagatgatcatgagcctgggcctggtgctggtgcacgcccacagcagatggatcgccgaccccagcccccagaacagcaccgccgacaccagcaaggtgagcctgggcctggacgagaacgtgagcaagagaatcgagcccagcgtgagcctgtggcagttctacctgagcaagatgatcagcatggacatcgagcaggtgatcaccctgagcctggccctgctgctggccgtgaagtacatcttcttcgagcagaccgagaccgagagcaccctgagcctgaagaaccccatcaccagccccgtggtgacccagaagaaggtgcccgacaactgctgcagaagagagcccatgctggtgagaaacaaccagaagtgcgacagcgtggaggaggagaccggcatcaacagagagagaaaggtggaggtgatcaagcccctggtggccgagaccgacacccccaacagagccaccttcgtggtgggcaacagcagcctgctggacaccagcagcgtgctggtgacccaggagcccgagatcgagctgcccagagagcccagacccaacgaggagtgcctgcagatcctgggcaacgccgagaagggcgccaagttcctgagcgacgccgagatcatccagctggtgaacgccaagcacatccccgcctacaagctggagaccctgatggagacccacgagagaggcgtgagcatcagaagacagctgctgagcaagaagctgagcgagcccagcagcctgcagtacctgccctacagagactacaactacagcctgctgggcggcggcgccagcagcagagtgctggccgacggcatgaccagaggccccgtggtgagactgcccagagcctgcgacagcgccgaggtgaaggcctggctggagaccagcgagggcttcgccgtgatcaaggaggccttcgacagcaccagcagattcgccagactgcagaagctgcacaccagcatcgccggcagaaacctgtacatcagattccagagcagaagcggcgacgccatgggcatgaacatgatcagcaagggcaccgagaaggccctgagcaagctgcacgagtacttccccgagatgcagatcctggccgtgagcggcaactactgcaccgacaagaagcccgccgccatcaactggatcgagggcagaggcaagagcgtggtgtgcgaggccgtgatccccgccaaggtggtgagagaggtgctgaagaccaccaccgaggccatgatcgaggtgaacatcaacaagaacctggtgggcagcgccatggccggcagcatcggcggctacaacgcccacgccgccaacatcgtgaccgccatctacatcgcctgcggccaggacgccgcccagaacgtgggcagcagcaactgcatcaccctgatggaggccagcggccccaccaacgaggacctgtacatcagctgcaccatgcccagcatcgagatcggcaccgtgggcggcggcaccaacctgctgccccagcaggcctgcctgcagatgctgggcgtgcagggcgcctgcaaggacaaccccggcgagaacgccagacagctggccagaatcgtgtgcggcaccgtgatggccggcgagctgagcctgatggccgccctggccgccggccacctggtgaagagccacatgatccacaacagaagcaagatcaacctgcaggacctgcagggcgcctgcaccaagaagaccgcctag

SEQ ID NO: 9206 - DNA, 798 bp, Artificial Sequence
  Description of Artificial Sequence: Synthetic coding sequence
atgctgagcagactgttcagaatgcacggcctgttcgtggccagccacccctgggaggtgatcgtgggcaccgtgaccctgaccatctgcatgatgagcatgaacatgttcaccgagggcaccgagaaggccctgagcaagctgcacgagtacttccccgagatgcagatcctggccgtgagcggcaactactgcaccgacaagaagcccgccgccatcaactggatcgagggcagaggcaagagcgtggtgtgcgaggccgtgatccccgccaaggtggtgagagaggtgctgaagaccaccaccgaggccatgatcgaggtgaacatcaacaagaacctggtgggcagcgccatggccggcagcatcggcggctacaacgcccacgccgccaacatcgtgaccgccatctacatcgcctgcggccaggacgccgcccagaacgtgggcagcagcaactgcatcaccctgatggaggccagcggccccaccaacgaggacctgtacatcagctgcaccatgcccagcatcgagatcggcaccgtgggcggcggcaccaacctgctgccccagcaggcctgcctgcagatgctgggcgtgcagggcgcctgcaaggacaaccccggcgagaacgccagacagctggccagaatcgtgtgcggcaccgtgatggccggcgagctgagcctgatggccgccctggccgccggccacctggtgaagagccacatgatccacaacagaagcaagatcaacctgcaggacctgcagggcgcctgcaccaagaagaccgcctag

SEQ ID NO: 9207 - DNA, 57 bp, Artificial Sequence
  Description of Artificial Sequence: Synthetic coding sequence
atgctgagcagactgttcagaatgcacggcctgttcgtggccagccacccctggtag

SEQ ID NO: 9208 - DNA, 336 bp, Artificial Sequence
  Description of Artificial Sequence: Synthetic coding sequence
atgctgagcagactgttcagaatgcacggcctgttcgtggccagccacccctgggaggtgatcgtgggcaccgtgaccctgaccatctgcatgatgagcatgaacatgttcaccggcaacaacaagatctgcggctggaactacgagtgccccaagttcgaggaggacgtgctgagcagcgacatcatcatcctgaccatcaccagatgcatcgccatcctgtacatctacttccagttccagaacctgagacagctgggcagcaagtacatcctgggcatcgccggcctgttcaccatcttcagcagcttcgtgttcagcaccgtggtgatctag

SEQ ID NO: 9209 - DNA, 2667 bp, Artificial Sequence; identical to SEQ ID NO: 9204
  Description of Artificial Sequence: Synthetic coding sequence

SEQ ID NO: 9210 - DNA, 2460 bp, Artificial Sequence
  Description of Artificial Sequence: Synthetic coding sequence
atgcacagccaccccgtgtacctgctgcccgtgcccgagttcaccagcacctggatcaagatctacttcggctactgctggcccttccacaacttcctgaagttctgcatccagtacagctgccacagcctgctgagacagagaatcgacagactggaggaggccctgcccttcttcctgctgctgatcgacctgagcagagccagcaccctggccaagttcgccctgagcagcaacagccaggacgaggtgagagagaacatcgccagaggcatggccatcctgggccccaccttcaccctggacgccctggtggagtgcctggtgatcggcgtgggcaccatgagcggcgtgagacagctggagatcatgtgctgcttcggctgcatgagcgtgctggccaactacttcgtgttcatgaccttcttccccgcctgcgtgagcctggtgctggagctgagcagagagagcagagagggcagacccatctggcagctgagccacttcgccagagtgctggaggaggaggagaacaagcccaaccccgtgacccagagagtgaagatgatcatgagcctgggcctggtgctggtgcacgcccacagcagatggatcgccgaccccagcccccagaacagcaccgccgacaccagcaaggtgagcctgggcctggacgagaacgtgagcaagagaatcgagcccagcgtgagcctgtggcagttctacctgagcaagatgatcagcatggacatcgagcaggtgatcaccctgagcctggccctgctgctggccgtgaagtacatcttcttcgagcagaccgagaccgagagcaccctgagcctgaagaaccccatcaccagccccgtggtgacccagaagaaggtgcccgacaactgctgcagaagagagcccatgctggtgagaaacaaccagaagtgcgacagcgtggaggaggagaccggcatcaacagagagagaaaggtggaggtgatcaagcccctggtggccgagaccgacacccccaacagagccaccttcgtggtgggcaacagcagcctgctggacaccagcagcgtgctggtgacccaggagcccgagatcgagctgcccagagagcccagacccaacgaggagtgcctgcagatcctgggcaacgccgagaagggcgccaagttcctgagcgacgccgagatcatccagctggtgaacgccaagcacatccccgcctacaagctggagaccctgatggagacccacgagagaggcgtgagcatcagaagacagctgctgagcaagaagctgagcgagcccagcagcctgcagtacctgccctacagagactacaactacagcctggtgatgggcgcctgctgcgagaacgtgatcggctacatgcccatccccgtgggcgtggccggccccctgtgcctggacgagaaggagttccaggtgcccatggccaccaccgagggctgcctggtggccagcaccaacagaggctgcagagccatcggcctgggcggcggcgccagcagcagagtgctggccgacggcatgaccagaggccccgtggtgagactgcccagagcctgcgacagcgccgaggtgaaggcctggctggagaccagcgagggcttcgccgtgatcaaggaggccttcgacagcaccagcagattcgccagactgcagaagctgcacaccagcatcgccggcagaaacctgtacatcagattccagagcagaagcggcgacgccatgggcatgaacatgatcagcaagggcaccgagaaggccctgagcaagctgcacgagtacttccccgagatgcagatcctggccgtgagcggcaactactgcaccgacaagaagcccgccgccatcaactggatcgagggcagaggcaagagcgtggtgtgcgaggccgtgatccccgccaaggtggtgagagaggtgctgaagaccaccaccgaggccatgatcgaggtgaacatcaacaagaacctggtgggcagcgccatggccggcagcatcggcggctacaacgcccacgccgccaacatcgtgaccgccatctacatcgcctgcggccaggacgccgcccagaacgtgggcagcagcaactgcatcaccctgatggaggccagcggccccaccaacgaggacctgtacatcagctgcaccatgcccagcatcgagatcggcaccgtgggcggcggcaccaacctgctgccccagcaggcctgcctgcagatgctgggcgtgcagggcgcctgcaaggacaaccccggcgagaacgccagacagctggccagaatcgtgtgcggcaccgtgatggccggcgagctgagcctgatggccgccctggccgccggccacctggtgaagagccacatgatccacaacagaagcaagatcaacctgcaggacctgcagggcgcctgcaccaagaagaccgcctag

SEQ ID NO: 9211 - DNA, 1671 bp, Artificial Sequence
  Description of Artificial Sequence: Synthetic coding sequence
atggccagaaccaccagccagctgtacgacgccgtgcccatccagagcagcgtggtgctgtgcagctgccccagccccagcatggtgagaacccagaccgagagcagcaccccccccggcatccccggcggcagcagacagggccccgccatggacggcaccgccgccgagcccagacccggcgccggcagcctgcagcacgcccagccccccccccagcccagaaagaagagacccgaggacttcaagttcggcaagatcctgggcgagggcagcttcagcaccgtggtgctggccagagagctggccaccagcagagagtacgccatcaagatcctggagaagagacacatcatcaaggagaacaaggtgccctacgtgaccagagagagagacgtgatgagcagactggaccaccccttcttcgtgaagctgtacttcaccttccaggacgacgagaagctgtacttcggcctgagctacgccaagaacggcgagctgctgaagtacatcagaaagatcggcagcttcgacgagacctgcaccagattctacaccgccgagatcgtgagcgccctggagtacctgcacggcaagggcatcatccacagagacctgaagcccgagaacatcctgctgaacgaggacatgcacatccagatcaccgacttcggcaccgccaaggtgctgagccccgagagcaagcaggccagagccaacagcttcgtgggcaccgcccagtacgtgagccccgagctgctgaccgagaagagcgcctgcaagagcagcgacctgtgggccctgggctgcatcatctaccagctggtggccggcctgccccccttcagagccggcaacgagtacctgatcttccagaagatcatcaagctggagtacgacttccccgagaagttcttccccaaggccagagacctggtggagaagctgctggtgctggacgccaccaagagactgggctgcgaggagatggagggctacggccccctgaaggcccaccccttcttcgagagcgtgacctgggagaacctgcaccagcagaccccccccaagctgaccgcctacctgcccgccatgagcgaggacgacgaggactgctacggcaactacgacaacctgctgagccagttcggctgcatgcaggtgagcagcagcagcagcagccacagcctgagcgccagcgacaccggcctgccccagagaagcggcagcaacatcgagcagtacatccacgacctggacagcaacagcttcgagctggacctgcagttcagcgaggacgagaagagactgctgctggagaagcaggccggcggcaacccctggcaccagttcgtggagaacaacctgatcctgaagatgggccccgtggacaagagaaagggcctgttcgccagaagaagacagctgctgctgaccgagggcccccacctgtactacgtggaccccgtgaacaaggtgctgaagggcgagatcccctggagccaggagctgagacccgaggccaagaacttcaagaccttcttcgtgcacacccccaacagaacctactacctgatggaccccagcggcaacgcccacaagtggtgcagaaagatccaggaggtgtggagacagagataccagagccaccccgacgccgccgtgcagtag

SEQ ID NO: 9212 - DNA, 1599 bp, Artificial Sequence
  Description of Artificial Sequence: Synthetic coding sequence
atggccagaaccaccagccagctgtacgacgccgtgcccatccagagcagcgtggtgctgtgcagctgccccagccccagcatggtgagaacccagaccgagagcagcaccccccccggcatccccggcggcagcagacagggccccgccatggacggcaccgccgccgagcccagacccggcgccggcagcctgcagcacgcccagccccccccccagcccagaaagaagagacccgaggacttcaagttcggcaagatcctgggcgagggcagcttcagcaccgtggtgctggccagagagctggccaccagcagagagtacgccatcaagatcctggagaagagacacatcatcaaggagaacaaggtgccctacgtgaccagagagagagacgtgatgagcagactggaccaccccttcttcgtgaagctgtacttcaccttccaggacgacgagaagctgtacttcggcctgagctacgccaagaacggcgagctgctgaagtacatcagaaagatcggcagcttcgacgagacctgcaccagattctacaccgccgagatcgtgagcgccctggagtacctgcacggcaagggcatcatccacagagacctgaagcccgagaacatcctgctgaacgaggacatgcacatccagatcaccgacttcggcaccgccaaggtgctgagccccgagagcaagcagggcgtgagcgacctgtgggccctgggctgcatcatctaccagctggtggccggcctgccccccttcagagccggcaacgagtacctgatcttccagaagatcatcaagctggagtacgacttccccgagaagttcttccccaaggccagagacctggtggagaagctgctggtgctggacgccaccaagagactgggctgcgaggagatggagggctacggccccctgaaggcccaccccttcttcgagagcgtgacctgggagaacctgcaccagcagaccccccccaagctgaccgcctacctgcccgccatgagcgaggacgacgaggactgctacggcaactacgacaacctgctgagccagttcggctgcatgcaggtgagcagcagcagcagcagccacagcctgagcgccagcgacaccggcctgccccagagaagcggcagcaacatcgagcagtacatccacgacctggacagcaacagcttcgagctggacctgcagttcagcgaggacgagaagagactgctgctggagaagcaggccggcggcaacccctggcaccagttcgtggagaacaacctgatcctgaagatgggccccgtggacaagagaaagggcctgttcgccagaagaagacagctgctgctgaccgagggcccccacctgtactacgtggaccccgtgaacaaggtgctgaagggcgagatcccctggagccaggagctgagacccgaggccaagaacttcaagaccttcttcgtgcacacccccaacagaacctactacctgatggaccccagcggcaacgcccacaagtggtgcagaaagatccaggaggtgtggagacagagataccagagccaccccgacgccgccgtgcagtag

SEQ ID NO: 9213 - DNA, 1479 bp, Artificial Sequence
  Description of Artificial Sequence: Synthetic coding sequence
agagcccaggacgagggcggccactgctggggcagcgccagcggcagaagaaccctgagaagaagaagagccgcccagagatgcggcggcggcgccagagccgacgccggccccatggccagaaccaccagccagctgtacgacgccgtgcccatccagagcagcgtggtgctgtgcagctgccccagccccagcatggtgagaacccagaccgagagcagcaccccccccggcatccccggcggcagcagacagggccccgccatggacggcaccgccgccgagcccagacccggcgccggcagcctgcagcacgcccagccccccccccagcccagaaagaagagacccgaggacttcaagttcggcaagatcctgggcgagggcagcttcagcaccgtggtgctggccagagagctggccaccagcagagagtacgccatcaagatcctggagaagagacacatcatcaaggagaacaaggtgccctacgtgaccagagagagagacgtgatgagcagactggaccaccccttcttcgtgaagctgtacttcaccttccaggacgacgagaagctgtacttcggcctgagctacgccaagaacggcgagctgctgaagtacatcagaaagatcggcagcttcgacgagacctgcaccagattctacaccgccgagatcgtgagcgccctggagtacctgcacggcaagggcatcatccacagagacctgaagcccgagaacatcctgctgaacgaggacatgcacatccagatcaccgacttcggcaccgccaaggtgctgagccccgagagcaagcaggccagagccaacagcttcgtgggcaccgcccagtacgtgagccccgagctgctgaccgagaagagcgcctgcaagagcagcgacctgtgggccctgggctgcatcatctaccagctggtggccggcctgccccccttcagagccggcaacgagtacctgatcttccagaagatcatcaagctggagtacgacttccccgagaagttcttccccaaggccagagacctggtggagaagctgctggtgctggacgccaccaagagactgggctgcgaggagatggagggctacggccccctgaaggcccaccccttcttcgagagcgtgacctgggagaacctgcaccagcagaccccccccaagctgaccgcctacctgcccgccatgagcgaggacgacgaggactgctacggcaactacgacaacctgctgagccagttcggctgcatgcaggtgagcagcagcagcagcagccacagcctgagcgccagcgacaccggcctgccccagagaagcggcagcaacatcgagcagtacatccacgacctggacagcaacagcttcgagctggacctgcagttcagcgaggacgagaagagactgctgctggagaagcaggccggcggcaacccctgcctgaccggcagaatcatctag

SEQ ID NO: 9214 - DNA, 1290 bp, Artificial Sequence
  Description of Artificial Sequence: Synthetic coding sequence
atggccagaaccaccagccagctgtacgacgccgtgcccatccagagcagcgtggtgctgtgcagctgccccagccccagcatggtgagaacccagaccgagagcagcaccccccccggcatccccggcggcagcagacagggccccgccatggacggcaccgccgccgagcccagacccggcgccggcagcctgcagcacgcccagccccccccccagcccagaaagaagagacccgaggacttcaagttcggcaagatcctgggcgagggcagcttcagcaccgtggtgctggccagagagctggccaccagcagagagtacgccaccagagccaacagcttcgtgggcaccgcccagtacgtgagccccgagctgctgaccgagaagagcgcctgcaagagcagcgacctgtgggccctgggctgcatcatctaccagctggtggccggcctgccccccttcagagccggcaacgagtacctgatcttccagaagatcatcaagctggagtacgacttccccgagaagttcttccccaaggccagagacctggtggagaagctgctggtgctggacgccaccaagagactgggctgcgaggagatggagggctacggccccctgaaggcccaccccttcttcgagagcgtgacctgggagaacctgcaccagcagaccccccccaagctgaccgcctacctgcccgccatgagcgaggacgacgaggactgctacggcaactacgacaacctgctgagccagttcggctgcatgcaggtgagcagcagcagcagcagccacagcctgagcgccagcgacaccggcctgccccagagaagcggcagcaacatcgagcagtacatccacgacctggacagcaacagcttcgagctggacctgcagttcagcgaggacgagaagagactgctgctggagaagcaggccggcggcaacccctggcaccagttcgtggagaacaacctgatcctgaagatgggccccgtggacaagagaaagggcctgttcgccagaagaagacagctgctgctgaccgagggcccccacctgtactacgtggaccccgtgaacaaggtgctgaagggcgagatcccctggagccaggagctgagacccgaggccaagaacttcaagaccttcttcgtgcacacccccaacagaacctactacctgatggaccccagcggcaacgcccacaagtggtgcagaaagatccaggaggtgtggagacagagataccagagccaccccgacgccgccgtgcagtag

SEQ ID NO: 9215 - DNA, 5121 bp, Artificial Sequence
  Description of Artificial Sequence: Synthetic coding sequence
atgggcgtgcccaagttctacagatggatcagcgagagatacccctgcctgagcgaggtggtgaaggagcaccagatccccgagttcgacaacctgtacctggacatgaacggcatcatccaccagtgcagccaccccaacgacgacgacgtgcacttcagaatcagcgacgacaagatcttcaccgacatcttccactacctggaggtgctgttcagaatcatcaagcccagaaaggtgttcttcatggccgtggacggcgtggcccccagagccaagatgaaccagcagagaggcagaagattcagaagcgccaaggaggccgaggacaagatcaagaaggccatcgagaagggcgagaccctgcccaccgaggccagattcgacagcaactgcatcacccccggcaccgagttcatggccagactgcacgagcacctgaagtacttcgtgaacatgaagatcagcaccgacaagagctggcagggcgtgaccatctacttcagcggccacgagacccccggcgagggcgagcacaagatcatggagttcatcagaagcgagaaggccaagcccgaccacgaccccaacaccagacactgcctgtacggcctggacgccgacctgatcatgctgggcctgaccagccacgaggcccacttcagcctgctgagagaggaggtgagattcggcggcaagaagacccagagagtgtgcgcccccgaggagaccaccttccacctgctgcacctgagcctgatgagagagtacatcgactacgagttcagcgtgctgaaggagaagatcaccttcaagtacgacatcgagagaatcatcgacgactggatcctgatgggcttcctggtgggcaacgacttcatcccccacctgccccacctgcacatcaaccacgacgccctgcccctgctgtacggcacctacgtgaccatcctgcccgagctgggcggctacatcaacgagagcggccacctgaacctgcccagattcgagaagtacctggtgaagctgagcgacttcgacagagagcacttcagcgaggtgttcgtggacctgaagtggttcgagagcaaggtgggcaacaagtacctgaacgaggccgccggcgtggccgccgaggaggccagaaactacaaggagaagaagaagctgaagggccaggagaacagcctgtgctggaccgccctggacaagaacgagggcgagatgatcaccagcaaggacaacctggaggacgagaccgaggacgacgacctgttcgagaccgagttcagacagtacaagagaacctactacatgaccaagatgggcgtggacgtggtgagcgacgacttcctggccgaccaggccgcctgctacgtgcaggccatccagtggatcctgcactactactaccacggcgtgcagagctggagctggtactacccctaccactacgcccccttcctgagcgacatccacaacatcagcaccctgaagatccacttcgagctgggcaagcccttcaagcccttcgagcagctgctggccgtgctgcccgccgccagcaagaacctgctgcccgcctgctaccagcacctgatgaccaacgaggacagccccatcatcgagtactacccccccgacttcaagaccgacctgaacggcaagcagcaggagtgggaggccgtggtgctgatccccttcatcgacgagaagagactgctggaggccatggagacctgcaaccacagcctgaagaaggaggagagaaagagaaaccagcacagcgagtgcctgatgtgctggtacgacagagacaccgagttcatctaccccagcccctggcccgagaagttccccgccatcgagagatgctgcaccagatacaagatcatcagcctggacgcctggagagtggacatcaacaagaacaagatcaccagaatcgaccagaaggccctgtacttctgcggcttccccaccctgaagcacatcagacacaagttcttcctgaagaagagcggcgtgcaggtgttccagcagagcagcagaggcgagaacatgatgctggagatcctggtggacgccgagagcgacgagctgaccgtggagaacgtggccagcagcgtgctgggcaagagcgtgttcgtgaactggccccacctggaggaggccagagtggtggccgtgagcgacggcgagaccaagttctacctggaggagccccccggcacccagaagctgtacagcggcagaaccgccccccccagcaaggtggtgcacctgggcgacaaggagcagagcaactgggccaaggaggtgcagggcatcagcgagcactacctgagaagaaagggcatcatcatcaacgagaccagcgccgtggtgtacgcccagctgctgaccggcagaaagtaccagatcaaccagaacggcgaggtgagactggagaagcagtggagcaagcaggtggtgcccttcgtgtaccagaccatcgtgaaggacatcagagccttcgacagcagattcagcaacatcaagaccctggacgacctgttccccctgagaagcatggtgttcatgctgggcaccccctactacggctgcaccggcgaggtgcaggacagcggcgacgtgatcaccgagggcagaatcagagtgatcttcagcatcccctgcgagcccaacctggacgccctgatccagaaccagcacaagtacagcatcaagtacaaccccggctacgtgctggccagcagactgggcgtgagcggctacctggtgagcagattcaccggcagcatcttcatcggcagaggcagcagaagaaacccccacggcgaccacaaggccaacgtgggcctgaacctgaagttcaacaagaagaacgaggaggtgcccggctacaccaagaaggtgggcagcgagtggatgtacagcagcgccgccgagcagctgctggccgagtacctggagagagcccccgagctgttcagctacatcgccaagaacagccaggaggacgtgttctacgaggacgacatctggcccggcgagaacgagaacggcgccgagaaggtgcaggagatcatcacctggctgaagggccaccccgtgagcaccctgagcagaagcagctgcgacctgcagatcctggacgccgccatcgtggagaagatcgaggaggaggtggagaagtgcaagcagagaaagaacaacaagaaggtgagagtgaccgtgaagccccacctgctgtacagacccctggagcagcagcacggcgtgatccccgacagagacgccgagttctgcctgttcgacagagtggtgaacgtgagagagaacttcagcgtgcccgtgggcctgagaggcaccatcatcggcatcaagggcgccaacagagaggccgacgtgctgttcgaggtgctgttcgacgaggagttccccggcggcctgaccatcagatgcagccccggcagaggctacagactgcccaccagcgccctggtgaacctgagccacggcagcagaagcgagaccggcaaccagaagctgaccgccatcgtgaagccccagcccgccgtgcaccagcacagcagcagcagcagcgtgagcagcggccacctgggcgccctgaaccacagcccccagagcctgttcgtgcccacccaggtgcccaccaaggacgacgacgagttctgcaacatctggcagagcctgcagggcagcggcaagatgcagtacttccagcccaccatccaggagaagggcgccgtgctgccccaggagatcagccaggtgaaccagcaccacaagagcggcttcaacgacaacagcgtgaagtaccagcagagaaagcacgacccccacagaaagttcaaggaggagtgcaagagccccaaggccgagtgctggagccagaagatgagcaacaagcagcccaacagcggcatcgagaacttcctggccagcctgaacatcagcaaggagaacgaggtgcagagcagccaccacggcgagccccccagcgaggagcacctgagcccccagagcttcgccatgggcaccagaatgctgaaggagatcctgaagatcgacggcagcaacaccgtggaccacaagaacgagatcaagcagatcgccaacgagatccccgtgagcagcaacagaagagacgagtacggcctgcccagccagcccaagcagaacaagaagctggccagctacatgaacaagccccacagcgccaacgagtaccacaacgtgcagagcatggacaacatgtgctggcccgcccccagccagatcccccccgtgagcacccccgtgaccgagctgagcagaatctgcagcctggtgggcatgccccagcccgacttcagcttcctgagaatgccccagaccatgaccgtgtgccaggtgaagctgagcaacggcctgctggtgcacggcccccagtgccacagcgagaacgaggccaaggagaaggccgccctgttcgccctgcagcagctgggcagcctgggcatgaacttccccctgcccagccaggtgttcgccaactaccccagcgccgtgccccccggcaccatcccccccgccttccccccccccaccggctgggaccactacggcagcaactacgccctgggcgccgccaacatcatgcccagcagcagccacctgttcggcagcatgccctggggccccagcgtgcccgtgcccggcaagcccttccaccacaccctgtacagcggcaccatgcccatggccggcggcatccccggcggcgtgcacaaccagttcatccccctgcaggtgaccaagaagagagtggccaacaagaagaacttcgagaacaaggaggcccagagcagccaggccacccccgtgcagaccagccagcccgacagcagcaacatcgtgaaggtgagccccagagagagcagcagcgccagcctgaagagcagccccatcgcccagcccgccagcagcttccaggtggagaccgccagccagggccacagcatcagccaccacaagagcacccccatcagcagcagcagaagaaagagcagaaagctggccgtgaacttcggcgtgagcaagcccagcgagtag

SEQ ID NO: 9216 - DNA, 5085 bp, Artificial Sequence
  Description of Artificial Sequence: Synthetic coding sequence
atgggcgtgcccaagttctacagatggatcagcgagagatacccctgcctgagcgaggtggtgaaggagcaccagatccccgagttcgacaacctgtacctggacatgaacggcatcatccaccagtgcagccaccccaacgacgacgacgtgcacttcagaatcagcgacgacaagatcttcaccgacatcttccactacctggaggtgctgttcagaatcatcaagcccagaaaggtgttcttcatggccgtggacggcgtggcccccagagccaagatgaaccagcagagaggcagaagattcagaagcgccaaggaggccgaggacaagatcaagaaggccatcgagaagggcgagaccctgcccaccgaggccagattcgacagcaactgcatcacccccggcaccgagttcatggccagactgcacgagcacctgaagtacttcgtgaacatgaagatcagcaccgacaagagctggcagggcgtgaccatctacttcagcggccacgagacccccggcgagggcgagcacaagatcatggagttcatcagaagcgagaaggccaagcccgaccacgaccccaacaccagacactgcctgtacggcctggacgccgacctgatcatgctgggcctgaccagccacgaggcccacttcagcctgctgagagaggaggtgagattcggcggcaagaagacccagagagtgtgcgcccccgaggagaccaccttccacctgctgcacctgagcctgatgagagagtacatcgactacgagttcagcgtgctgaaggagaagatcaccttcaagtacgacatcgagagaatcatcgacgactggatcctgatgggcttcctggtgggcaacgacttcatcccccacctgccccacctgcacatcaaccacgacgccctgcccctgctgtacggcacctacgtgaccatcctgcccgagctgggcggctacatcaacgagagcggccacctgaacctgcccagattcgagaagtacctggtgaagctgagcgacttcgacagagagcacttcagcgaggtgttcgtggacctgaagtggttcgagagcaaggtgggcaacaagtacctgaacgaggccgccggcgtggccgccgaggaggccagaaactacaaggagaagaagaagctgaagggccaggagaacagcctgtgctggaccgccctggacaagaacgagggcgagatgatcaccagcaaggacaacctggaggacgagaccgaggacgacgacctgttcgagaccgagttcagacagtacaagagaacctactacatgaccaagatgggcgtggacgtggtgagcgacgacttcctggccgaccaggccgcctgctacgtgcaggccatccagtggatcctgcactactactaccacggcgtgcagagctggagctggtactacccctaccactacgcccccttcctgagcgacatccacaacatcagcaccctgaagatccacttcgagctgggcaagcccttcaagcccttcgagcagctgctggccgtgctgcccgccgccagcaagaacctgctgcccgcctgctaccagcacctgatgaccaacgaggacagccccatcatcgagtactacccccccgacttcaagaccgacctgaacggcaagcagcaggagtgggaggccgtggtgctgatccccttcatcgacgagaagagactgctggaggccatggagacctgcaaccacagcctgaagaaggaggagagaaagagaaaccagcacagcgagtgcctgatgtgctggtacgacagagacaccgagttcatctaccccagcccctggcccgagaagttccccgccatcgagagatgctgcaccagatacaagatcatcagcctggacgcctggagagtggacatcaacaagaacaagatcaccagaatcgaccagaaggccctgtacttctgcggcttccccaccctgaagcacatcagacacaagttcttcctgaagaagagcggcgtgcaggtgttccagcagagcagcagaggcgagaacatgatgctggagatcctggtggacgccgagagcgacgagctgaccgtggagaacgtggccagcagcgtgctgggcaagagcgtgttcgtgaactggccccacctggaggaggccagagtggtggccgtgagcgacggcgagaccaagttctacctggaggagccccccggcacccagaagctgtacagcggcagaaccgccccccccagcaaggtggtgcacctgggcgacaaggagcagagcaactgggccaaggaggtgcagggcatcagcgagcactacctgagaagaaagggcatcatcatcaacgagaccagcgccgtggtgtacgcccagctgctgaccggcagaaagtaccagatcaaccagaacggcgaggtgagactggagaagcagtggagcaagcaggtggtgcccttcgtgtaccagaccatcgtgaaggacatcagagccttcgacagcagattcagcaacatcaagaccctggacgacctgttccccctgagaagcatggtgttcatgctgggcaccccctactacggctgcaccggcgaggtgcaggacagcggcgacgtgatcaccgagggcagaatcagagtgatcttcagcatcccctgcgagcccaacctggacgccctgatccagaaccagcacaagtacagcatcaagtacaaccccggctacgtgctggccagcagactgggcgtgagcggctacctggtgagcagattcaccggcagcatcttcatcggcagaggcagcagaagaaacccccacggcgaccacaaggccaacgtgggcctgaacctgaagttcaacaagaagaacgaggaggtgcccggctacaccaagaaggtgggcagcgagtggatgtacagcagcgccgccgagcagctgctggccgagtacctggagagagcccccgagctgttcagctacatcgccaagaacagccaggaggacgtgttctacgaggacgacatctggcccggcgagaacgagaacggcgccgagaaggtgcaggagatcatcacctggctgaagggccaccccgtgagcaccctgagcagaagcagctgcgacctgcagatcctggacgccgccatcgtggagaagatcgaggaggaggtggagaagtgcaagcagagaaagaacaacaagaaggtgagagtgaccgtgaagccccacctgctgtacagacccctggagcagcagcacggcgtgatccccgacagagacgccgagttctgcctgttcgacagagtggtgaacgtgagagagaacttcagcgtgcccgtgggcctgagaggcaccatcatcggcatcaagggcgccaacagagaggccgacgtgctgttcgaggtgctgttcgacgaggagttccccggcggcctgaccatcagatgcagccccggcagaggctacagactgcccaccagcgccctggtgaacctgagccacggcagcagaagcgagaccggcaaccagaagctgaccgccatcgtgaagccccagcccgccgtgcaccagcacagcagcagcagcagcgtgagcagcggccacctgggcgccctgaaccacagcccccagagcctgttcgtgcccacccaggtgcccaccaaggacgacgacgagttctgcaacatctggcagagcctgcagggcagcggcaagatgcagtacttccagcccaccatccaggagaagggcgccgtgctgccccaggagatcagccaggtgaaccagcaccacaagagcggcttcaacgacaacagcgtgaagtaccagcagagaaagcacgacccccacagaaagttcaaggaggagtgcaagagccccaaggccgagtgctggagccagaagatgagcaacaagcagcccaacagcggcatcgagaacttcctggccagcctgaacatcagcaaggagaacgaggtgcagagcagccaccacggcgagccccccagcgaggagcacctgagcccccagagcttcgccatgaagggcaccagaatgctgaaggagatcctgaagatcgacggcagcaacaccgtggaccacaagaacgagatcaagcagatcgccaacgagatccccgtgagcagcaacagaagagacgagtacggcctgcccagccagcccaagcagaacaagaagctggccagctacatgaacaagccccacagcgccaacgagtaccacaacgtgcagagcatggacaacatgtgctggcccgcccccagccagatcccccccgtgagcacccccgtgaccgagctgagcagaatctgcagcctggtgggcatgccccagcccgacttcagcttcctgagaatgccccagaccatgaccgtgtgccaggtgaagctgagcaacggcctgctggtgcacggcccccagtgccacagcgagaacgaggccaaggagaaggccgccctgttcgccctgcagcagctgggcagcctgggcatgaacttccccctgcccagccaggtgttcgccaactaccccagcgccgtgccccccggcaccatcccccccgccttccccccccccaccgccaacatcatgcccagcagcagccacctgttcggcagcatgccctggggccccagcgtgcccgtgcccggcaagcccttccaccacaccctgtacagcggcaccatgcccatggccggcggcatccccggcggcgtgcacaaccagttcatccccctgcaggtgaccaagaagagagtggccaacaagaagaacttcgagaacaaggaggcccagagcagccaggccacccccgtgcagaccagccagcccgacagcagcaacatcgtgaaggtgagccccagagagagcagcagcgccagcctgaagagcagccccatcgcccagcccgccagcagcttccaggtggagaccgccagccagggccacagcatcagccaccacaagagcacccccatcagcagcagcagaagaaagagcagaaagctggccgtgaacttcggcgtgagcaagcccagcgagtag

SEQ ID NO: 9217 - DNA, 1380 bp, Artificial Sequence
  Description of Artificial Sequence: Synthetic coding sequence
atgggcgtgcccaagttctacagatggatcagcgagagatacccctgcctgagcgaggtggtgaaggagcaccagatccccgagttcgacaacctgtacctggacatgaacggcatcatccaccagtgcagccaccccaacgacgacgacgtgcacttcagaatcagcgacgacaagatcttcaccgacatcttccactacctggaggtgctgttcagaatcatcaagcccagaaaggtgttcttcatggccgtggacggcgtggcccccagagccaagatgaaccagcagagaggcagaagattcagaagcgccaaggaggccgaggacaagatcaagaaggccatcgagaagggcgagaccctgcccaccgaggccagattcgacagcaactgcatcacccccggcaccgagttcatggccagactgcacgagcacctgaagtacttcgtgaacatgaagatcagcaccgacaagagctggcagggcgtgaccatctacttcagcggccacgagacccccggcgagggcgagcacaagatcatggagttcatcagaagcgagaaggccaagcccgaccacgaccccaacaccagacactgcctgtacggcctggacgccgacctgatcatgctgggcctgaccagccacgaggcccacttcagcctgctgagagaggaggtgagattcggcggcaagaagacccagagagtgtgcgcccccgaggagaccaccttccacctgctgcacctgagcctgatgagagagtacatcgactacgagttcagcgtgctgaaggagaagatcaccttcaagtacgacatcgagagaatcatcgacgactggatcctgatgggcttcctggtgggcaacgacttcatcccccacctgccccacctgcacatcaaccacgacgccctgcccctgctgtacggcacctacgtgaccatcctgcccgagctgggcggctacatcaacgagagcggccacctgaacctgcccagattcgagaagtacctggtgaagctgagcgacttcgacagagagcacttcagcgaggtgttcgtggacctgaagtggttcgagagcaaggtgggcaacaagtacctgaacgaggccgccggcgtggccgccgaggaggccagaaactacaaggagaagaagaagctgaagggccaggagaacagcctgtgctggaccgccctggacaagaacgagggcgagatgatcaccagcaaggacaacctggaggacgagaccgaggacgacgacctgttcgagaccgagttcagacagtacaagagaacctactacatgaccaagatgggcgtggacgtggtgagcgagtacgtgttcgccaacgccttcatcctgaagtag

SEQ ID NO: 9218 - DNA, 750 bp, Artificial Sequence
  Description of Artificial Sequence: Synthetic coding sequence
atgctgggcctgaccagccacgaggcccacttcagcctgctgagagaggaggtgagattcggcggcaagaagacccagagagtgtgcgcccccgaggagaccaccttccacctgctgcacctgagcctgatgagagagtacatcgactacgagttcagcgtgctgaaggagaagatcaccttcaagtacgacatcgagagaatcatcgacgactggatcctgatgggcttcctggtgggcaacgacttcatcccccacctgccccacctgcacatcaaccacgacgccctgcccctgctgtacggcacctacgtgaccatcctgcccgagctgggcggctacatcaacgagagcggccacctgaacctgcccagattcgagaagtacctggtgaagctgagcgacttcgacagagagcacttcagcgaggtgttcgtggacctgaagtggttcgagagcaaggtgggcaacaagtacctgaacgaggccgccggcgtggccgccgaggaggccagaaactacaaggagaagaagaagctgaagggccaggagaacagcctgtgctggaccgccctggacaagaacgagggcgagatgatcaccagcaaggacaacctggaggacgagaccgaggacgacgacctgttcgagaccgagttcagacagtacaagagaacctactacatgaccaagatgggcgtggacgtggtgagcgagtacgtgttcgccaacgccttcatcctgaagtag

SEQ ID NO: 9219 - DNA, 3483 bp, Artificial Sequence
  Description of Artificial Sequence: Synthetic coding sequence
tgaaccaacgaggacagccccatcatcgagtactacccccccgacttcaagaccgacctgaacggcaagcagcaggagtgggaggccgtggtgctgatccccttcatcgacgagagactgctggaggccatggagacctgcaaccacagcctgaagaaggaggagagaaagagaaaccagcacagcgagtgcctgatgtgctggtacgacagagacaccgagttcatctaccccagcccctggcccgagaagttccccgccatcgagagatgctgcaccagatacaagatcatcagcctggacgcctggagagtggacatcaacaagaacaagatcaccagaatcgaccagaaggccctgtacttctgcggcttccccaccctgaagcacatcagacacaagttcttcctgaagaagagcggcgtgcaggtgttccagcagagcagcagaggcgagaacatgatgctggagatcctggtggacgccgagagcgacgagctgaccgtggagaacgtggccagcagcgtgctgggcaagagcgtgttcgtgaactggccccacctggaggaggccagagtggtggccgtgagcgacggcgagaccaagttctacctggaggagccccccggcacccagaagctgtacagcggcagaaccgccccccccagcaaggtggtgcacctgggcgacaaggagcagagcaactgggccaaggaggtgcagggcatcagcgagcactacctgagaagaaagggcatcatcatcaacgagaccagcgccgtggtgtacgcccagctgctgaccggcagaaagtaccagatcaaccagaacggcgaggtgagactggagaagcagtggagcaagcaggtggtgcccttcgtgtaccagaccatcgtgaaggacatcagagccttcgacagcagattcagcaacatcaagaccctggacgacctgttccccctgagaagcatggtgttcatgctgggcaccccctactacggctgcaccggcgaggtgcaggacagcggcgacgtgatcaccgagggcagaatcagagtgatcttcagcatcccctgcgagcccaacctggacgccctgatccagaaccagcacaagtacagcatcaagtacaaccccggctacgtgctggccagcagactgggcgtgagcggctacctggtgagcagattcaccggcagcatcttcatcggcagaggcagcagaagaaacccccacggcgaccacaaggccaacgtgggcctgaacctgaagttcaacaagaagaacgaggaggtgcccggctacaccaagaaggtgggcagcgagtggatgtacagcagcgccgccgagcagctgctggccgagtacctggagagagcccccgagctgttcagctacatcgccaagaacagccaggaggacgtgttctacgaggacgacatctggcccggcgagaacgagaacggcgccgagaaggtgcaggagatcatcacctggctgaagggccaccccgtgagcaccctgagcagaagcagctgcgacctgcagatcctggacgccgccatcgtggagaagatcgaggaggaggtggagaagtgcaagcagagaaagaacaacaagaaggtgagagtgaccgtgaagccccacctgctgtacagacccctggagcagcagcacggcgtgatccccgacagagacgccgagttctgcctgttcgacagagtggtgaacgtgagagagaacttcagcgtgcccgtgggcctgagaggcaccatcatcggcatcaagggcgccaacagagaggccgacgtgctgttcgaggtgctgttcgacgaggagttccccggcggcctgaccatcagatgcagccccggcagaggctacagactgcccaccagcgccctggtgaacctgagccacggcagcagaagcgagaccggcaaccagaagctgaccgccatcgtgaagccccagcccgccgtgcaccagcacagcagcagcagcagcgtgagcagcggccacctgggcgccctgaaccacagcccccagagcctgttcgtgcccacccaggtgcccaccaaggacgacgacgagttctgcaacatctggcagagcctgcagggcagcggcaagatgcagtacttccagcccaccatccaggagaagggcgccgtgctgccccaggagatcagccaggtgaaccagcaccacaagagcggcttcaacgacaacagcgtgaagtaccagcagagaaagcacgacccccacagaaagttcaaggaggagtgcaagagccccaaggccgagtgctggagccagaagatgagcaacaagcagcccaacagcggcatcgagaacttcctggccagcctgaacatcagcaaggagaacgaggtgcagagcagccaccacggcgagccccccagcgaggagcacctgagcccccagagcttcgccatgaagggcaccagaatgctgaaggagatcctgaagatcgacggcagcaacaccgtggaccacaagaacgagatcaagcagatcgccaacgagatccccgtgagcagcaacagaagagacgagtacggcctgcccagccagcccaagcagaacaagaagctggccagctacatgaacaagccccacagcgccaacgagtaccacaacgtgcagagcatggacaacatgtgctggcccgcccccagccagatcccccccgtgagcacccccgtgaccgagctgagcagaatctgcagcctggtgggcatgccccagcccgacttcagcttcctgagaatgccccagaccatgaccgtgtgccaggtgaagctgagcaacggcctgctggtgcacggcccccagtgccacagcgagaacgaggccaaggagaaggccgccctgttcgccctgcagcagctgggcagcctgggcatgaacttccccctgcccagccaggtgttcgccaactaccccagcgccgtgccccccggcaccatcccccccgccttccccccccccaccgccaacatcatgcccagcagcagccacctgttcggcagcatgccctggggccccagcgtgcccgtgcccggcaagcccttccaccacaccctgtacagcggcaccatgcccatggccggcggcatccccggcggcgtgcacaaccagttcatccccctgcaggtgaccaagaagagagtggccaacaagaagaacttcgagaacaaggaggcccagagcagccaggccacccccgtgcagaccagccagcccgacagcagcaacatcgtgaaggtgagccccagagagagcagcagcgccagcctgaagagcagccccatcgcccagcccgccagcagcttccaggtggagaccgccagccagggccacagcatcagccaccacaagagcacccccatcagcagcagcagaagaaagagcagaaagctggccgtgaacttcggcgtgagcaagcccagcgagtag

SEQ ID NO: 9220 - DNA, 1233 bp, Artificial Sequence
  Description of Artificial Sequence: Synthetic coding sequence
atgcccgccagagccctgctgcccagaagaatgggccacagaaccctggccagcacccccgccctgtgggccagcatcccctgccccagaagcgagctgagactggacctggtgctgcccagcggccagagcttcagatggagagagcagagccccgcccactggagcggcgtgctggccgaccaggtgtggaccctgacccagaccgaggagcagctgcactgcaccgtgtacagaggcgacaagagccaggccagcagacccacccccgacgagctggaggccgtgagaaagtacttccagctggacgtgaccctggcccagctgtaccaccactggggcagcgtggacagccacttccaggaggtggcccagaagttccagggcgtgagactgctgagacaggaccccatcgagtgcctgttcagcttcatctgcagcagcaacaacaacatcgccagaatcaccggcatggtggagagactgtgccaggccttcggccccagactgatccagctggacgacgtgacctaccacggcttccccagcctgcaggccctggccggccccgaggtggaggcccacctgagaaagctgggcctgggctacagagccagatacgtgagcgccagcgccagagccatcctggaggagcagggcggcctggcctggctgcagcagctgagagagagcagctacgaggaggcccacaaggccctgtgcatcctgcccggcgtgggcaccaaggtggccgactgcatctgcctgatggccctggacaagccccaggccgtgcccgtggacgtgcacatgtggcacatcgcccagagagactacagctggcaccccaccaccagccaggccaagggccccagcccccagaccaacaaggagctgggcaacttcttcagaagcctgtggggcccctacgccggctgggcccaggccaccccccccagctacagatgctgcagcgtgcccacctgcgccaaccccgccatgctgagaagccaccagcagagcgccgagagagtgcccaagggcagaaaggccagatggggcaccctggacaaggagatcccccaggcccccagcccccccttccccaccagcctgagccccagcccccccagcctgatgctgggcagaggcctgcccgtgaccaccagcaaggccagacacccccagatcaagcagagcgtgtgcaccaccagatggggcggcggctactag

SEQ ID NO: 9221 - DNA, 1071 bp, Artificial Sequence
  Description of Artificial Sequence: Synthetic coding sequence
atgcccgccagagccctgctgcccagaagaatgggccacagaaccctggccagcacccccgccctgtgggccagcatcccctgccccagaagcgagctgagactggacctggtgctgcccagcggccagagcttcagatggagagagcagagccccgcccactggagcggcgtgctggccgaccaggtgtggaccctgacccagaccgaggagcagctgcactgcaccgtgtacagaggcgacaagagccaggccagcagacccacccccgacgagctggaggccgtgagaaagtacttccagctggacgtgaccctggcccagctgtaccaccactggggcagcgtggacagccacttccaggaggtggcccagaagttccagggcgtgagactgctgagacaggaccccatcgagtgcctgttcagcttcatctgcagcagcaacaacaacatcgccagaatcaccggcatggtggagagactgtgccaggccttcggccccagactgatccagctggacgacgtgacctaccacggcttccccagcctgcaggccctggccggccccgaggtggaggcccacctgagaaagctgggcctgggctacagagccagatacgtgagcgccagcgccagagccatcctggaggagcagggcggcctggcctggctgcagcagctgagagagagcagctacgaggaggcccacaaggccctgtgcatcctgcccggcgtgggcaccaaggtggccgactgcatctgcctgatggccctggacaagccccaggccgtgcccgtggacgtgcacatgtggcacatcgcccagagagactacagctggcaccccaccaccagccaggccaagggccccagcccccagaccaacaaggagctgggcaacttcttcagaagcctgtggggcccctacgccggctgggcccaggccctgtgccaggtgatcaccaccttcatgaccttcctgggcccccacagactggaccagatgccccccgaggagctgcagaccagcagcagcagactgggcggccccccctggcagtgcatctag

SEQ ID NO: 9222 - DNA, 1275 bp, Artificial Sequence
  Description of Artificial Sequence: Synthetic coding sequence
atgcccgccagagccctgctgcccagaagaatgggccacagaaccctggccagcacccccgccctgtgggccagcatcccctgccccagaagcgagctgagactggacctggtgctgcccagcggccagagcttcagatggagagagcagagccccgcccactggagcggcgtgctggccgaccaggtgtggaccctgacccagaccgaggagcagctgcactgcaccgtgtacagaggcgacaagagccaggccagcagacccacccccgacgagctggaggccgtgagaaagtacttccagctggacgtgaccctggcccagctgtaccaccactggggcagcgtggacagccacttccaggaggtggcccagaagttccagggcgtgagactgctgagacaggaccccatcgagtgcctgttcagcttcatctgcagcagcaacaacaacatcgccagaatcaccggcatggtggagagactgtgccaggccttcggccccagactgatccagctggacgacgtgacctaccacggcttccccagcctgcaggccctggccggccccgaggtggaggcccacctgagaaagctgggcctgggctacagagccagatacgtgagcgccagcgccagagccatcctggaggagcagggcggcctggcctggctgcagcagctgagagagagcagctacgaggaggcccacaaggccctgtgcatcctgcccggcgtgggcaccaaggtggccgactgcatctgcctgatggccctggacaagccccaggccgtgcccgtggacgtgcacatgtggcacatcgcccagagagactacagctggcaccccaccaccagccaggccaagggccccagcccccagaccaacaaggagctgggcaacttcttcagaagcctgtggggcccctacgccggctgggcccaggccggcctgctgggcaacgccttcgacggccaccagctgctgagacccctgatcttctgccaggaccacctgagagagggcccccccatcggcagaggcgacagccagggcgaggagctggagccccagctgcccagcagcctgagcagcatcccctacggcttctgcgaccactgctggaccaaggacgtggacgacccccccctggtgacccaccccagccccggcagcagagacggccacatgacccaggcctggcccgtgaaggtggtgagccccctggccaccgtgatcggccacgtgatgcaggccagcctgctggccctgtag

SEQ ID NO: 9223 - DNA, 975 bp, Artificial Sequence
  Description of Artificial Sequence: Synthetic coding sequence
atgcccgccagagccctgctgcccagaagaatgggccacagaaccctggccagcacccccgccctgtgggccagcatcccctgccccagaagcgagctgagactggacctggtgctgcccagcggccagagcttcagatggagagagcagagccccgcccactggagcggcgtgctggccgaccaggtgtggaccctgacccagaccgaggagcagctgcactgcaccgtgtacagaggcgacaagagccaggccagcagacccacccccgacgagctggaggccgtgagaaagtacttccagctggacgtgaccctggcccagctgtaccaccactggggcagcgtggacagccacttccaggaggtggcccagaagttccagggcgtgagactgctgagacaggaccccatcgagtgcctgttcagcttcatctgcagcagcaacaacaacatcgccagaatcaccggcatggtggagagactgtgccaggccttcggccccagactgatccagctggacgacgtgacctaccacggcttccccagcctgcaggccctggccggccccgaggtggaggcccacctgagaaagctgggcctgggctacagagccagatacgtgagcgccagcgccagagccatcctggaggagcagggcggcctggcctggctgcagcagctgagagagagcagctacgaggaggcccacaaggccctgtgcatcctgcccggcgtgggcaccaaggtggccgactgcatctgcctgatggccctggacaagccccaggccgtgcccgtggacgtgcacatgtggcacatcgcccagagagactacagctggcaccccaccaccagccaggccaagggccccagcccccagaccaacaaggagctgggcaacttcttcagaagcctgtggggcccctacgccggctgggcccaggccgtgagcgtgcccagatgccccccctag

SEQ ID NO: 9224 - DNA, 594 bp, Artificial Sequence
  Description of Artificial Sequence: Synthetic coding sequence
atggtggagagactgtgccaggccttcggccccagactgatccagctggacgacgtgacctaccacggcttccccagcctgcaggccctggccggccccgaggtggaggcccacctgagaaagctgggcctgggctacagagccagatacgtgagcgccagcgccagagccatcctggaggagcagggcggcctggcctggctgcagcagctgagagagagcagctacgaggaggcccacaaggccctgtgcatcctgcccggcgtgggcaccaaggagaccttcagcggcgcctgcggcgacctgatgctggccggccccaagagatgctgcagcgtgcccacctgcgccaaccccgccatgctgagaagccaccagcagagcgccgagagagtgcccaagggcagaaaggccagatggggcaccctggacaaggagatcccccaggcccccagcccccccttccccaccagcctgagccccagcccccccagcctgatgctgggcagaggcctgcccgtgaccaccagcaaggccagacacccccagatcaagcagagcgtgtgcaccaccagatggggcggcggctactag

SEQ ID NO: 9225 - DNA, 1038 bp, Artificial Sequence
  Description of Artificial Sequence: Synthetic coding sequence
atgcccgccagagccctgctgcccagaagaatgggccacagaaccctggccagcacccccgccctgtgggccagcatcccctgccccagaagcgagctgagactggacctggtgctgcccagcggccagagcttcagatggagagagcagagccccgcccactggagcggcgtgctggccgaccaggtgtggaccctgacccagaccgaggagcagctgcactgcaccgtgtacagaggcgacaagagccaggccagcagacccacccccgacgagctggaggccgtgagaaagtacttccagctggacgtgaccctggcccagctgtaccaccactggggcagcgtggacagccacttccaggaggtggcccagaagttccagggcgtgagactgctgagacaggaccccatcgagtgcctgttcagcttcatctgcagcagcaacaacaacatcgccagaatcaccggcatggtggagagactgtgccaggccttcggccccagactgatccagctggacgacgtgacctaccacggcttccccagcctgcaggccctggccggccccgaggtggaggcccacctgagaaagctgggcctgggctacagagccagatacgtgagcgccagcgccagagccatcctggaggagcagggcggcctggcctggctgcagcagctgagagagagcagctacgaggaggcccacaaggccctgtgcatcctgcccggcgtgggcaccaaggtggccgactgcatctgcctgatggccctggacaagccccaggccgtgcccgtggacgtgcacatgtggcacatcgcccagagagactacagctggcaccccaccaccagccaggccaagggccccagcccccagaccaacaaggagctgggcaacttcttcagaagcctgtggggcccctacgccggctgggcccaggccgtgctgttcagcgccgacctgagacagagcagacacgcccaggagccccccgccaagagaagaaagggcagcaagggccccgagggctag

SEQ ID NO: 9226 - DNA, 1074 bp, Artificial Sequence
  Description of Artificial Sequence: Synthetic coding sequence
atgcccgccagagccctgctgcccagaagaatgggccacagaaccctggccagcacccccgccctgtgggccagcatcccctgccccagaagcgagctgagactggacctggtgctgcccagcggccagagcttcagatggagagagcagagccccgcccactggagcggcgtgctggccgaccaggtgtggaccctgacccagaccgaggagcagctgcactgcaccgtgtacagaggcgacaagagccaggccagcagacccacccccgacgagctggaggccgtgagaaagtacttccagctggacgtgaccctggcccagctgtaccaccactggggcagcgtggacagccacttccaggaggtggcccagaagttccagggcgtgagactgctgagacaggaccccatcgagtgcctgttcagcttcatctgcagcagcaacaacaacatcgccagaatcaccggcatggtggagagactgtgccaggccttcggccccagactgatccagctggacgacgtgacctaccacggcttccccagcctgcaggccctggccggccccgaggtggaggcccacctgagaaagctgggcctgggctacagagccagatacgtgagcgccagcgccagagccatcctggaggagcagggcggcctggcctggctgcagcagctgagagagagcagctacgaggaggcccacaaggccctgtgcatcctgcccggcgtgggcaccaagggcctgctgggcaacgccttcgacggccaccagctgctgagacccctgatcttctgccaggaccacctgagagagggcccccccatcggcagaggcgacagccagggcgaggagctggagccccagctgcccagcagcctgagcagcatcccctacggcttctgcgaccactgctggaccaaggacgtggacgacccccccctggtgacccaccccagccccggcagcagagacggccacatgacccaggcctggcccgtgaaggtggtgagccccctggccaccgtgatcggccacgtgatgcaggccagcctgctggccctgtag

SEQ ID NO: 9227 - DNA, 588 bp, Artificial Sequence
  Description of Artificial Sequence: Synthetic coding sequence
atgcccgccagagccctgctgcccagaagaatgggccacagaaccctggccagcacccccgccctgtgggccagcatcccctgccccagaagcgagctgagactggacctggtgctgcccagcggccagagcttcagatggagagagcagagccccgcccactggagcggcgtgctggccgaccaggtgtggaccctgacccagaccgaggagcagctgcactgcaccgtgtacagaggcgacaagagccaggccagcagacccacccccgacgagctggaggccgtgagaaagtacttccagctggacgtgaccctggcccagctgtaccaccactggggcagcgtggacagccacttccaggaggtggcccagaagttccagggcgtgagactgctgagacaggaccccatcgagtgcctgttcagcttcatctgcagcagcaacaacaacatcgccagaatcaccggcatggtggagagactgtgccaggccttcggccccagactgatccagctggacgacgtgacctaccacggcttccccagcctgcaggccctggccggccccccctggcagtgcatctag

SEQ ID NO: 9228 - DNA, 969 bp, Artificial Sequence
  Description of Artificial Sequence: Synthetic coding sequence
atgcccgccagagccctgctgcccagaagaatgggccacagaaccctggccagcacccccgccctgtgggccagcatcccctgccccagaagcgagctgagactggacctggtgctgcccagcggccagagcttcagatggagagagcagagccccgcccactggagcggcgtgctggccgaccaggtgtggaccctgacccagaccgaggagcagctgcactgcaccgtgtacagaggcgacaagagccaggccagcagacccacccccgacgagctggaggccgtgagaaagtacttccagctggacgtgaccctggcccagctgtaccaccactggggcagcgtggacagccacttccaggaggtggcccagaagttccagggcgtgagactgctgagacaggaccccatcgagtgcctgttcagcttcatctgcagcagcaacaacaacatcgccagaatcaccggcatggtggagagactgtgccaggccttcggccccagactgatccagctggacgacgtgacctaccacggcttccccagcctgcaggccctggccggccccgaggtggaggcccacctgagaaagctgggcctgggctacagagccagatacgtgagcgccagcgccagagccatcctggaggagcagggcggcctggcctggctgcagcagctgagagagagcagctacgaggaggcccacaaggccctgtgcatcctgcccggcgtgggcaccaaggtggccgactgcatctgcctgatggccctggacaagccccaggccgtgcccgtggacgtgcacatgtggcacatcgcccagagagactacagctggcaccccaccaccagccaggccaagggccccagcccccagaccaacaaggagctgggcaacttcttcagaagcctgtggggcccctacgccggctgggcccaggccgccggcagcgacgccagctag

SEQ ID NO: 9229 - DNA, 6807 bp, Artificial Sequence
  Description of Artificial Sequence: Synthetic coding sequence
atgagcggcctgcacctggtgaagcagggcagagacagaaagaagatcgacagccagagagacttcaccgtggccagccccgccgagttcgtgaccagattcggcggcaacaaggtgatcgagaaggtgctgatcgccaacaacggcatcgccgccgtgaagtgcatgagaagcatcagaagatggagctacgagatgttcagaaacgagagagccatcagattcgtggtgatggtgacccccgaggacctgaaggccaacgccgagtacatcaagatggccgaccactacgtgcccgtgcccggcggccccaacaacaacaactacgccaacgtggagctgatcctggacatcgccaagagaatccccgtgcaggccgtgtgggccggctggggccacgccagcgagaaccccaagctgcccgagctgctgctgaagaacggcatcgccttcatgggcccccccagccaggccatgtgggccctgggcgacaagatcgccagcagcatcgtggcccagaccgccggcatccccaccctgccctggagcggcagcggcctgagagtggactggcaggagaacgacttcagcaagagaatcctgaacgtgccccaggagctgtacgagaagggctacgtgaaggacgtggacgacggcctgcaggccgccgaggaggtgggctaccccgtgatgatcaaggccagcgagggcggcggcggcaagggcatcagaaaggtgaacaacgccgacgacttccccaacctgttcagacaggtgcaggccgaggtgcccggcagccccatcttcgtgatgagactggccaagcagagcagacacctggaggtgcagatcctggccgaccagtacggcaacgccatcagcctgttcggcagagactgcagcgtgcagagaagacaccagaagatcatcgaggaggcccccgccaccatcgccacccccgccgtgttcgagcacatggagcagtgcgccgtgaagctggccaagatggtgggctacgtgagcgccggcaccgtggagtacctgtacagccaggacggcagcttctacttcctggagctgaaccccagactgcaggtggagcacccctgcaccgagatggtggccgacgtgaacctgcccgccgcccagctgcagatcgccatgggcatccccctgtacagaatcaaggacatcagaatgatgtacggcgtgagcccctggggcgacagccccatcgacttcgaggacagcgcccacgtgccctgccccagaggccacgtgatcgccgccagaatcaccagcgagaaccccgacgagggcttcaagcccagcagcggcaccgtgcaggagctgaacttcagaagcaacaagaacgtgtggggctacttcagcgtggccgccgccggcggcctgcacgagttcgccgacagccagttcggccactgcttcagctggggcgagaacagagaggaggccatcagcaacatggtggtggccctgaaggagctgagcatcagaggcgacttcagaaccaccgtggagtacctgatcaagctgctggagaccgagagcttccagatgaacagaatcgacaccggctggctggacagactgatcgccgagaaggtgcaggccgagagacccgacaccatgctgggcgtggtgtgcggcgccctgcacgtggccgacgtgagcctgagaaacagcgtgagcaacttcctgcacagcctggagagaggccaggtgctgcccgcccacaccctgctgaacaccgtggacgtggagctgatctacgagggcgtgaagtacgtgctgaaggtgaccagacagagccccaacagctacgtggtgatcatgaacggcagctgcgtggaggtggacgtgcacagactgagcgacggcggcctgctgctgagctacgacggcagcagctacaccacctacatgaaggaggaggtggacagatacagaatcaccatcggcaacaagacctgcgtgttcgagaaggagaacgaccccagcgtgatgagaagccccagcgccggcaagctgatccagtacatcgtggaggacggcggccacgtgttcgccggccagtgctacgccgagatcgaggtgatgaagatggtgatgaccctgaccgccgtggagagcggctgcatccactacgtgaagagacccggcgccgccctggaccccggctgcgtgctggccaagatgcagctggacaaccccagcaaggtgcagcaggccgagctgcacaccggcagcctgcccagaatccagagcaccgccctgagaggcgagaagctgcacagagtgttccactacgtgctggacaacctggtgaacgtgatgaacggctactgcctgcccgaccccttcttcagcagcaaggtgaaggactgggtggagagactgatgaagaccctgagagaccccagcctgcccctgctggagctgcaggacatcatgaccagcgtgagcggcagaatcccccccaacgtggagaagagcatcaagaaggagatggcccagtacgccagcaacatcaccagcgtgctgtgccagttccccagccagcagatcgccaacatcctggacagccacgccgccaccctgaacagaaagagcgagagagaggtgttcttcatgaacacccagagcatcgtgcagctggtgcagagatacagaagcggcatcagaggccacatgaaggccgtggtgatggacctgctgagacagtacctgagagtggagacccagttccagaacggccactacgacaagtgcgtgttcgccctgagagaggagaacaagagcgacatgaacaccgtgctgaactacatcttcagccacgcccaggtgaccaagaagaacctgctggtgaccatgctgatcgaccagctgtgcggcagagaccccaccctgaccgacgagctgctgaacatcctgaccgagctgacccagctgagcaagaccaccaacgccaaggtggccctgagagccagacaggtgctgatcgccagccacctgcccagctacgagctgagacacaaccaggtggagagcatcttcctgagcgccatcgacatgtacggccaccagttctgcatcgagaacctgcagaagctgatcctgagcgagaccagcatcttcgacgtgctgcccaacttcttctaccacagcaaccaggtggtgagaatggccgccctggaggtgtacgtgagaagagcctacatcgcctacgagctgaacagcgtgcagcacagacagctgaaggacaacacctgcgtggtggagttccagttcatgctgcccaccagccaccccaacagaggcaacatccccaccctgaacagaatgagcttcagcagcaacctgaaccactacggcatgacccacgtggccagcgtgagcgacgtgctgctggacaacagcttcacccccccctgccagagaatgggcggcatggtgagcttcagaaccttcgaggacttcgtgagaatcttcgacgaggtgatgggctgcttcagcgacagccccccccagagccccaccttccccgaggccggccacaccagcctgtacgacgaggacaaggtgcccagagacgagcccatccacatcctgaacgtggccatcaagaccgactgcgacatcgaggacgacagactggccgccatgttcagagagttcacccagcagaacaaggccaccctggtggaccacggcatcagaagactgaccttcctggtggcccagaaggacttcagaaagcaggtgaactacgaggtggacagaagattccacagagagttccccaagttcttcaccttcagagccagagacaagttcgaggaggacagaatctacagacacctggagcccgccctggccttccagctggagctgaacagaatgagaaacttcgacctgaccgccatcccctgcgccaaccacaagatgcacctgtacctgggcgccgccaaggtggaggtgggcaccgaggtgaccgactacagattcttcgtgagagccatcatcagacacagcgacctggtgaccaaggaggccagcttcgagtacctgcagaacgagggcgagagactgctgctggaggccatggacgagctggaggtggccttcaacaacaccaacgtgagaaccgactgcaaccacatcttcctgaacttcgtgcccaccgtgatcatggaccccagcaagatcgaggagagcgtgagaagcatggtgatgagatacggcagcagactgtggaagctgagagtgctgcaggccgagctgaagatcaacatcagactgacccccaccggcaaggccatccccatcagactgttcctgaccaacgagagcggctactacctggacatcagcctgtacaaggaggtgaccgacagcagaaccgcccagatcatgttccaggcctacggcgacaagcagggccccctgcacggcatgctgatcaacaccccctacgtgaccaaggacctgctgcagagcaagagattccaggcccagagcctgggcaccacctacatctacgacatccccgagatgttcagacagagcctgatcaagctgtgggagagcatgagcacccaggccttcctgcccagcccccccctgcccagcgacatgctgacctacaccgagctggtgctggacgaccagggccagctggtgcacatgaacagactgcccggcggcaacgagatcggcatggtggcctggaagatgaccttcaagagccccgagtaccccgagggcagagacatcatcgtgatcggcaacgacatcacctacagaatcggcagcttcggcccccaggaggacctgctgttcctgagagccagcgagctggccagagccgagggcatccccagaatctacgtgagcgccaacagcggcgccagaatcggcctggccgaggagatcagacacatgttccacgtggcctgggtggaccccgaggacccctacaagggctacagatacctgtacctgaccccccaggactacaagagagtgagcgccctgaacagcgtgcactgcgagcacgtggaggacgagggcgagagcagatacaagatcaccgacatcatcggcaaggaggagggcatcggccccgagaacctgagaggcagcggcatgatcgccggcgagagcagcctggcctacaacgagatcatcaccatcagcctggtgacctgcagagccatcggcatcggcgcctacctggtgagactgggccagagaaccatccaggtggagaacagccacctgatcctgaccggcgccggcgccctgaacaaggtgctgggcagagaggtgtacaccagcaacaaccagctgggcggcatccagatcatgcacaacaacggcgtgacccactgcaccgtgtgcgacgacttcgagggcgtgttcaccgtgctgcactggctgagctacatgcccaagagcgtgcacagcagcgtgcccctgctgaacagcaaggaccccatcgacagaatcatcgagttcgtgcccaccaagaccccctacgaccccagatggatgctggccggcagaccccaccccacccagaagggccagtggctgagcggcttcttcgactacggcagcttcagcgagatcatgcagccctgggcccagaccgtggtggtgggcagagccagactgggcggcatccccgtgggcgtggtggccgtggagaccagaaccgtggagctgagcatccccgccgaccccgccaacctggacagcgaggccaagatcatccagcaggccggccaggtgtggttccccgacagcgccttcaagacctaccaggccatcaaggacttcaacagagagggcctgcccctgatggtgttcgccaactggagaggcttcagcggcggcatgaaggacatgtacgaccaggtgctgaagttcggcgcctacatcgtggacggcctgagagagtgctgccagcccgtgctggtgtacatccccccccaggccgagctgagaggcggcagctgggtggtgatcgacagcagcatcaaccccagacacatggagatgtacgccgacagagagagcagaggcagcgtgctggagcccgagggcaccgtggagatcaagttcagaagaaaggacctggtgaagaccatgagaagagtggaccccgtgtacatccacctggccgagagactgggcacccccgagctgagcaccgccgagagaaaggagctggagaacaagctgaaggagagagaggagttcctgatccccatctaccaccaggtggccgtgcagttcgccgacctgcacgacacccccggcagaatgcaggagaagggcgtgatcagcgacatcctggactggaagaccagcagaaccttcttctactggagactgagaagactgctgctggaggacctggtgaagaagaagatccacaacgccaaccccgagctgaccgacggccagatccaggccatgctgagaagatggttcgtggaggtggagggcaccgtgaaggcctacgtgtgggacaacaacaaggacctggccgagtggctggagaagcagctgaccgaggaggacggcgtgcacagcgtgatcgaggagaacatcaagtgcatcagcagagactacgtgctgaagcagatcagaagcctggtgcaggccaaccccgaggtggccatggacagcatcatccacatgacccagcacatcagccccacccagagagccgaggtgatcagaatcctgagcaccatggacagccccagcacctag

SEQ ID NO: 9230 - DNA, 7152 bp, Artificial Sequence
  Description of Artificial Sequence: Synthetic coding sequence
atgtggtggagcaccctgatgagcatcctgagagccagaagcttctggaagtggatcagcacccagaccgtgagaatcatcagagccgtgagagcccacttcggcggcatcatggacgagcccagccccctggcccagcccctggagctgaaccagcacagcagattcatcatcggcagcgtgagcgaggacaacagcgaggacgagatcagcaacctggtgaagctggacctgctggaggagaaggagggcagcctgagccccgccagcgtgggcagcgacaccctgagcgacctgggcatcagcagcctgcaggacggcctggccctgcacatcagaagcagcatgagcggcctgcacctggtgaagcagggcagagacagaaagaagatcgacagccagagagacttcaccgtggccagccccgccgagttcgtgaccagattcggcggcaacaaggtgatcgagaaggtgctgatcgccaacaacggcatcgccgccgtgaagtgcatgagaagcatcagaagatggagctacgagatgttcagaaacgagagagccatcagattcgtggtgatggtgacccccgaggacctgaaggccaacgccgagtacatcaagatggccgaccactacgtgcccgtgcccggcggccccaacaacaacaactacgccaacgtggagctgatcctggacatcgccaagagaatccccgtgcaggccgtgtgggccggctggggccacgccagcgagaaccccaagctgcccgagctgctgctgaagaacggcatcgccttcatgggcccccccagccaggccatgtgggccctgggcgacaagatcgccagcagcatcgtggcccagaccgccggcatccccaccctgccctggagcggcagcggcctgagagtggactggcaggagaacgacttcagcaagagaatcctgaacgtgccccaggagctgtacgagaagggctacgtgaaggacgtggacgacggcctgcaggccgccgaggaggtgggctaccccgtgatgatcaaggccagcgagggcggcggcggcaagggcatcagaaaggtgaacaacgccgacgacttccccaacctgttcagacaggtgcaggccgaggtgcccggcagccccatcttcgtgatgagactggccaagcagagcagacacctggaggtgcagatcctggccgaccagtacggcaacgccatcagcctgttcggcagagactgcagcgtgcagagaagacaccagaagatcatcgaggaggcccccgccaccatcgccacccccgccgtgttcgagcacatggagcagtgcgccgtgaagctggccaagatggtgggctacgtgagcgccggcaccgtggagtacctgtacagccaggacggcagcttctacttcctggagctgaaccccagactgcaggtggagcacccctgcaccgagatggtggccgacgtgaacctgcccgccgcccagctgcagatcgccatgggcatccccctgtacagaatcaaggacatcagaatgatgtacggcgtgagcccctggggcgacagccccatcgacttcgaggacagcgcccacgtgccctgccccagaggccacgtgatcgccgccagaatcaccagcgagaaccccgacgagggcttcaagcccagcagcggcaccgtgcaggagctgaacttcagaagcaacaagaacgtgtggggctacttcagcgtggccgccgccggcggcctgcacgagttcgccgacagccagttcggccactgcttcagctggggcgagaacagagaggaggccatcagcaacatggtggtggccctgaaggagctgagcatcagaggcgacttcagaaccaccgtggagtacctgatcaagctgctggagaccgagagcttccagatgaacagaatcgacaccggctggctggacagactgatcgccgagaaggtgcaggccgagagacccgacaccatgctgggcgtggtgtgcggcgccctgcacgtggccgacgtgagcctgagaaacagcgtgagcaacttcctgcacagcctggagagaggccaggtgctgcccgcccacaccctgctgaacaccgtggacgtggagctgatctacgagggcgtgaagtacgtgctgaaggtgaccagacagagccccaacagctacgtggtgatcatgaacggcagctgcgtggaggtggacgtgcacagactgagcgacggcggcctgctgctgagctacgacggcagcagctacaccacctacatgaaggaggaggtggacagatacagaatcaccatcggcaacaagacctgcgtgttcgagaaggagaacgaccccagcgtgatgagaagccccagcgccggcaagctgatccagtacatcgtggaggacggcggccacgtgttcgccggccagtgctacgccgagatcgaggtgatgaagatggtgatgaccctgaccgccgtggagagcggctgcatccactacgtgaagagacccggcgccgccctggaccccggctgcgtgctggccaagatgcagctggacaaccccagcaaggtgcagcaggccgagctgcacaccggcagcctgcccagaatccagagcaccgccctgagaggcgagaagctgcacagagtgttccactacgtgctggacaacctggtgaacgtgatgaacggctactgcctgcccgaccccttcttcagcagcaaggtgaaggactgggtggagagactgatgaagaccctgagagaccccagcctgcccctgctggagctgcaggacatcatgaccagcgtgagcggcagaatcccccccaacgtggagaagagcatcaagaaggagatggcccagtacgccagcaacatcaccagcgtgctgtgccagttccccagccagcagatcgccaacatcctggacagccacgccgccaccctgaacagaaagagcgagagagaggtgttcttcatgaacacccagagcatcgtgcagctggtgcagagatacagaagcggcatcagaggccacatgaaggccgtggtgatggacctgctgagacagtacctgagagtggagacccagttccagaacggccactacgacaagtgcgtgttcgccctgagagaggagaacaagagcgacatgaacaccgtgctgaactacatcttcagccacgcccaggtgaccaagaagaacctgctggtgaccatgctgatcgaccagctgtgcggcagagaccccaccctgaccgacgagctgctgaacatcctgaccgagctgacccagctgagcaagaccaccaacgccaaggtggccctgagagccagacaggtgctgatcgccagccacctgcccagctacgagctgagacacaaccaggtggagagcatcttcctgagcgccatcgacatgtacggccaccagttctgcatcgagaacctgcagaagctgatcctgagcgagaccagcatcttcgacgtgctgcccaacttcttctaccacagcaaccaggtggtgagaatggccgccctggaggtgtacgtgagaagagcctacatcgcctacgagctgaacagcgtgcagcacagacagctgaaggacaacacctgcgtggtggagttccagttcatgctgcccaccagccaccccaacagaggcaacatccccaccctgaacagaatgagcttcagcagcaacctgaaccactacggcatgacccacgtggccagcgtgagcgacgtgctgctggacaacagcttcacccccccctgccagagaatgggcggcatggtgagcttcagaaccttcgaggacttcgtgagaatcttcgacgaggtgatgggctgcttcagcgacagccccccccagagccccaccttccccgaggccggccacaccagcctgtacgacgaggacaaggtgcccagagacgagcccatccacatcctgaacgtggccatcaagaccgactgcgacatcgaggacgacagactggccgccatgttcagagagttcacccagcagaacaaggccaccctggtggaccacggcatcagaagactgaccttcctggtggcccagaaggacttcagaaagcaggtgaactacgaggtggacagaagattccacagagagttccccaagttcttcaccttcagagccagagacaagttcgaggaggacagaatctacagacacctggagcccgccctggccttccagctggagctgaacagaatgagaaacttcgacctgaccgccatcccctgcgccaaccacaagatgcacctgtacctgggcgccgccaaggtggaggtgggcaccgaggtgaccgactacagattcttcgtgagagccatcatcagacacagcgacctggtgaccaaggaggccagcttcgagtacctgcagaacgagggcgagagactgctgctggaggccatggacgagctggaggtggccttcaacaacaccaacgtgagaaccgactgcaaccacatcttcctgaacttcgtgcccaccgtgatcatggaccccagcaagatcgaggagagcgtgagaagcatggtgatgagatacggcagcagactgtggaagctgagagtgctgcaggccgagctgaagatcaacatcagactgacccccaccggcaaggccatccccatcagactgttcctgaccaacgagagcggctactacctggacatcagcctgtacaaggaggtgaccgacagcagaaccgcccagatcatgttccaggcctacggcgacaagcagggccccctgcacggcatgctgatcaacaccccctacgtgaccaaggacctgctgcagagcaagagattccaggcccagagcctgggcaccacctacatctacgacatccccgagatgttcagacagagcctgatcaagctgtgggagagcatgagcacccaggccttcctgcccagcccccccctgcccagcgacatgctgacctacaccgagctggtgctggacgaccagggccagctggtgcacatgaacagactgcccggcggcaacgagatcggcatggtggcctggaagatgaccttcaagagccccgagtaccccgagggcagagacatcatcgtgatcggcaacgacatcacctacagaatcggcagcttcggcccccaggaggacctgctgttcctgagagccagcgagctggccagagccgagggcatccccagaatctacgtgagcgccaacagcggcgccagaatcggcctggccgaggagatcagacacatgttccacgtggcctgggtggaccccgaggacccctacaagggctacagatacctgtacctgaccccccaggactacaagagagtgagcgccctgaacagcgtgcactgcgagcacgtggaggacgagggcgagagcagatacaagatcaccgacatcatcggcaaggaggagggcatcggccccgagaacctgagaggcagcggcatgatcgccggcgagagcagcctggcctacaacgagatcatcaccatcagcctggtgacctgcagagccatcggcatcggcgcctacctggtgagactgggccagagaaccatccaggtggagaacagccacctgatcctgaccggcgccggcgccctgaacaaggtgctgggcagagaggtgtacaccagcaacaaccagctgggcggcatccagatcatgcacaacaacggcgtgacccactgcaccgtgtgcgacgacttcgagggcgtgttcaccgtgctgcactggctgagctacatgcccaagagcgtgcacagcagcgtgcccctgctgaacagcaaggaccccatcgacagaatcatcgagttcgtgcccaccaagaccccctacgaccccagatggatgctggccggcagaccccaccccacccagaagggccagtggctgagcggcttcttcgactacggcagcttcagcgagatcatgcagccctgggcccagaccgtggtggtgggcagagccagactgggcggcatccccgtgggcgtggtggccgtggagaccagaaccgtggagctgagcatccccgccgaccccgccaacctggacagcgaggccaagatcatccagcaggccggccaggtgtggttccccgacagcgccttcaagacctaccaggccatcaaggacttcaacagagagggcctgcccctgatggtgttcgccaactggagaggcttcagcggcggcatgaaggacatgtacgaccaggtgctgaagttcggcgcctacatcgtggacggcctgagagagtgctgccagcccgtgctggtgtacatccccccccaggccgagctgagaggcggcagctgggtggtgatcgacagcagcatcaaccccagacacatggagatgtacgccgacagagagagcagaggcagcgtgctggagcccgagggcaccgtggagatcaagttcagaagaaaggacctggtgaagaccatgagaagagtggaccccgtgtacatccacctggccgagagactgggcacccccgagctgagcaccgccgagagaaaggagctggagaacaagctgaaggagagagaggagttcctgatccccatctaccaccaggtggccgtgcagttcgccgacctgcacgacacccccggcagaatgcaggagaagggcgtgatcagcgacatcctggactggaagaccagcagaaccttcttctactggagactgagaagactgctgctggaggacctggtgaagaagaagatccacaacgccaaccccgagctgaccgacggccagatccaggccatgctgagaagatggttcgtggaggtggagggcaccgtgaaggcctacgtgtgggacaacaacaaggacctggccgagtggctggagaagcagctgaccgaggaggacggcgtgcacagcgtgatcgaggagaacatcaagtgcatcagcagagactacgtgctgaagcagatcagaagcctggtgcaggccaaccccgaggtggccatggacagcatcatccacatgacccagcacatcagccccacccagagagccgaggtgatcagaatcctgagcaccatggacagccccagcacctag

SEQ ID NO: 9231 - DNA, 6867 bp, Artificial Sequence
  Description of Artificial Sequence: Synthetic coding sequence
atggagggcagccccgaggagaacaaggagatgagatactacatgctgcagagaagcagcatgagcggcctgcacctggtgaagcagggcagagacagaaagaagatcgacagccagagagacttcaccgtggccagccccgccgagttcgtgaccagattcggcggcaacaaggtgatcgagaaggtgctgatcgccaacaacggcatcgccgccgtgaagtgcatgagaagcatcagaagatggagctacgagatgttcagaaacgagagagccatcagattcgtggtgatggtgacccccgaggacctgaaggccaacgccgagtacatcaagatggccgaccactacgtgcccgtgcccggcggccccaacaacaacaactacgccaacgtggagctgatcctggacatcgccaagagaatccccgtgcaggccgtgtgggccggctggggccacgccagcgagaaccccaagctgcccgagctgctgctgaagaacggcatcgccttcatgggcccccccagccaggccatgtgggccctgggcgacaagatcgccagcagcatcgtggcccagaccgccggcatccccaccctgccctggagcggcagcggcctgagagtggactggcaggagaacgacttcagcaagagaatcctgaacgtgccccaggagctgtacgagaagggctacgtgaaggacgtggacgacggcctgcaggccgccgaggaggtgggctaccccgtgatgatcaaggccagcgagggcggcggcggcaagggcatcagaaaggtgaacaacgccgacgacttccccaacctgttcagacaggtgcaggccgaggtgcccggcagccccatcttcgtgatgagactggccaagcagagcagacacctggaggtgcagatcctggccgaccagtacggcaacgccatcagcctgttcggcagagactgcagcgtgcagagaagacaccagaagatcatcgaggaggcccccgccaccatcgccacccccgccgtgttcgagcacatggagcagtgcgccgtgaagctggccaagatggtgggctacgtgagcgccggcaccgtggagtacctgtacagccaggacggcagcttctacttcctggagctgaaccccagactgcaggtggagcacccctgcaccgagatggtggccgacgtgaacctgcccgccgcccagctgcagatcgccatgggcatccccctgtacagaatcaaggacatcagaatgatgtacggcgtgagcccctggggcgacagccccatcgacttcgaggacagcgcccacgtgccctgccccagaggccacgtgatcgccgccagaatcaccagcgagaaccccgacgagggcttcaagcccagcagcggcaccgtgcaggagctgaacttcagaagcaacaagaacgtgtggggctacttcagcgtggccgccgccggcggcctgcacgagttcgccgacagccagttcggccactgcttcagctggggcgagaacagagaggaggccatcagcaacatggtggtggccctgaaggagctgagcatcagaggcgacttcagaaccaccgtggagtacctgatcaagctgctggagaccgagagcttccagatgaacagaatcgacaccggctggctggacagactgatcgccgagaaggtgcaggccgagagacccgacaccatgctgggcgtggtgtgcggcgccctgcacgtggccgacgtgagcctgagaaacagcgtgagcaacttcctgcacagcctggagagaggccaggtgctgcccgcccacaccctgctgaacaccgtggacgtggagctgatctacgagggcgtgaagtacgtgctgaaggtgaccagacagagccccaacagctacgtggtgatcatgaacggcagctgcgtggaggtggacgtgcacagactgagcgacggcggcctgctgctgagctacgacggcagcagctacaccacctacatgaaggaggaggtggacagatacagaatcaccatcggcaacaagacctgcgtgttcgagaaggagaacgaccccagcgtgatgagaagccccagcgccggcaagctgatccagtacatcgtggaggacggcggccacgtgttcgccggccagtgctacgccgagatcgaggtgatgaagatggtgatgaccctgaccgccgtggagagcggctgcatccactacgtgaagagacccggcgccgccctggaccccggctgcgtgctggccaagatgcagctggacaaccccagcaaggtgcagcaggccgagctgcacaccggcagcctgcccagaatccagagcaccgccctgagaggcgagaagctgcacagagtgttccactacgtgctggacaacctggtgaacgtgatgaacggctactgcctgcccgaccccttcttcagcagcaaggtgaaggactgggtggagagactgatgaagaccctgagagaccccagcctgcccctgctggagctgcaggacatcatgaccagcgtgagcggcagaatcccccccaacgtggagaagagcatcaagaaggagatggcccagtacgccagcaacatcaccagcgtgctgtgccagttccccagccagcagatcgccaacatcctggacagccacgccgccaccctgaacagaaagagcgagagagaggtgttcttcatgaacacccagagcatcgtgcagctggtgcagagatacagaagcggcatcagaggccacatgaaggccgtggtgatggacctgctgagacagtacctgagagtggagacccagttccagaacggccactacgacaagtgcgtgttcgccctgagagaggagaacaagagcgacatgaacaccgtgctgaactacatcttcagccacgcccaggtgaccaagaagaacctgctggtgaccatgctgatcgaccagctgtgcggcagagaccccaccctgaccgacgagctgctgaacatcctgaccgagctgacccagctgagcaagaccaccaacgccaaggtggccctgagagccagacaggtgctgatcgccagccacctgcccagctacgagctgagacacaaccaggtggagagcatcttcctgagcgccatcgacatgtacggccaccagttctgcatcgagaacctgcagaagctgatcctgagcgagaccagcatcttcgacgtgctgcccaacttcttctaccacagcaaccaggtggtgagaatggccgccctggaggtgtacgtgagaagagcctacatcgcctacgagctgaacagcgtgcagcacagacagctgaaggacaacacctgcgtggtggagttccagttcatgctgcccaccagccaccccaacagaggcaacatccccaccctgaacagaatgagcttcagcagcaacctgaaccactacggcatgacccacgtggccagcgtgagcgacgtgctgctggacaacagcttcacccccccctgccagagaatgggcggcatggtgagcttcagaaccttcgaggacttcgtgagaatcttcgacgaggtgatgggctgcttcagcgacagccccccccagagccccaccttccccgaggccggccacaccagcctgtacgacgaggacaaggtgcccagagacgagcccatccacatcctgaacgtggccatcaagaccgactgcgacatcgaggacgacagactggccgccatgttcagagagttcacccagcagaacaaggccaccctggtggaccacggcatcagaagactgaccttcctggtggcccagaaggacttcagaaagcaggtgaactacgaggtggacagaagattccacagagagttccccaagttcttcaccttcagagccagagacaagttcgaggaggacagaatctacagacacctggagcccgccctggccttccagctggagctgaacagaatgagaaacttcgacctgaccgccatcccctgcgccaaccacaagatgcacctgtacctgggcgccgccaaggtggaggtgggcaccgaggtgaccgactacagattcttcgtgagagccatcatcagacacagcgacctggtgaccaaggaggccagcttcgagtacctgcagaacgagggcgagagactgctgctggaggccatggacgagctggaggtggccttcaacaacaccaacgtgagaaccgactgcaaccacatcttcctgaacttcgtgcccaccgtgatcatggaccccagcaagatcgaggagagcgtgagaagcatggtgatgagatacggcagcagactgtggaagctgagagtgctgcaggccgagctgaagatcaacatcagactgacccccaccggcaaggccatccccatcagactgttcctgaccaacgagagcggctactacctggacatcagcctgtacaaggaggtgaccgacagcagaaccgcccagatcatgttccaggcctacggcgacaagcagggccccctgcacggcatgctgatcaacaccccctacgtgaccaaggacctgctgcagagcaagagattccaggcccagagcctgggcaccacctacatctacgacatccccgagatgttcagacagagcctgatcaagctgtgggagagcatgagcacccaggccttcctgcccagcccccccctgcccagcgacatgctgacctacaccgagctggtgctggacgaccagggccagctggtgcacatgaacagactgcccggcggcaacgagatcggcatggtggcctggaagatgaccttcaagagccccgagtaccccgagggcagagacatcatcgtgatcggcaacgacatcacctacagaatcggcagcttcggcccccaggaggacctgctgttcctgagagccagcgagctggccagagccgagggcatccccagaatctacgtgagcgccaacagcggcgccagaatcggcctggccgaggagatcagacacatgttccacgtggcctgggtggaccccgaggacccctacaagggctacagatacctgtacctgaccccccaggactacaagagagtgagcgccctgaacagcgtgcactgcgagcacgtggaggacgagggcgagagcagatacaagatcaccgacatcatcggcaaggaggagggcatcggccccgagaacctgagaggcagcggcatgatcgccggcgagagcagcctggcctacaacgagatcatcaccatcagcctggtgacctgcagagccatcggcatcggcgcctacctggtgagactgggccagagaaccatccaggtggagaacagccacctgatcctgaccggcgccggcgccctgaacaaggtgctgggcagagaggtgtacaccagcaacaaccagctgggcggcatccagatcatgcacaacaacggcgtgacccactgcaccgtgtgcgacgacttcgagggcgtgttcaccgtgctgcactggctgagctacatgcccaagagcgtgcacagcagcgtgcccctgctgaacagcaaggaccccatcgacagaatcatcgagttcgtgcccaccaagaccccctacgaccccagatggatgctggccggcagaccccaccccacccagaagggccagtggctgagcggcttcttcgactacggcagcttcagcgagatcatgcagccctgggcccagaccgtggtggtgggcagagccagactgggcggcatccccgtgggcgtggtggccgtggagaccagaaccgtggagctgagcatccccgccgaccccgccaacctggacagcgaggccaagatcatccagcaggccggccaggtgtggttccccgacagcgccttcaagacctaccaggccatcaaggacttcaacagagagggcctgcccctgatggtgttcgccaactggagaggcttcagcggcggcatgaaggacatgtacgaccaggtgctgaagttcggcgcctacatcgtggacggcctgagagagtgctgccagcccgtgctggtgtacatccccccccaggccgagctgagaggcggcagctgggtggtgatcgacagcagcatcaaccccagacacatggagatgtacgccgacagagagagcagaggcagcgtgctggagcccgagggcaccgtggagatcaagttcagaagaaaggacctggtgaagaccatgagaagagtggaccccgtgtacatccacctggccgagagactgggcacccccgagctgagcaccgccgagagaaaggagctggagaacaagctgaaggagagagaggagttcctgatccccatctaccaccaggtggccgtgcagttcgccgacctgcacgacacccccggcagaatgcaggagaagggcgtgatcagcgacatcctggactggaagaccagcagaaccttcttctactggagactgagaagactgctgctggaggacctggtgaagaagaagatccacaacgccaaccccgagctgaccgacggccagatccaggccatgctgagaagatggttcgtggaggtggagggcaccgtgaaggcctacgtgtgggacaacaacaaggacctggccgagtggctggagaagcagctgaccgaggaggacggcgtgcacagcgtgatcgaggagaacatcaagtgcatcagcagagactacgtgctgaagcagatcagaagcctggtgcaggccaaccccgaggtggccatggacagcatcatccacatgacccagcacatcagccccacccagagagccgaggtgatcagaatcctgagcaccatggacagccccagcacctag

SEQ ID NO: 9232 - DNA, 1419 bp, Artificial Sequence
  Description of Artificial Sequence: Synthetic coding sequence
atgcacaacaacggcgtgacccactgcaccgtgtgcgacgacttcgagggcgtgttcaccgtgctgcactggctgagctacatgcccaagagcgtgcacagcagcgtgcccctgctgaacagcaaggaccccatcgacagaatcatcgagttcgtgcccaccaagaccccctacgaccccagatggatgctggccggcagaccccaccccacccagaagggccagtggctgagcggcttcttcgactacggcagcttcagcgagatcatgcagccctgggcccagaccgtggtggtgggcagagccagactgggcggcatccccgtgggcgtggtggccgtggagaccagaaccgtggagctgagcatccccgccgaccccgccaacctggacagcgaggccaagatcatccagcaggccggccaggtgtggttccccgacagcgccttcaagacctaccaggccatcaaggacttcaacagagagggcctgcccctgatggtgttcgccaactggagaggcttcagcggcggcatgaaggacatgtacgaccaggtgctgaagttcggcgcctacatcgtggacggcctgagagagtgctgccagcccgtgctggtgtacatccccccccaggccgagctgagaggcggcagctgggtggtgatcgacagcagcatcaaccccagacacatggagatgtacgccgacagagagagcagaggcagcgtgctggagcccgagggcaccgtggagatcaagttcagaagaaaggacctggtgaagaccatgagaagagtggaccccgtgtacatccacctggccgagagactgggcacccccgagctgagcaccgccgagagaaaggagctggagaacaagctgaaggagagagaggagttcctgatccccatctaccaccaggtggccgtgcagttcgccgacctgcacgacacccccggcagaatgcaggagaagggcgtgatcagcgacatcctggactggaagaccagcagaaccttcttctactggagactgagaagactgctgctggaggacctggtgaagaagaagatccacaacgccaaccccgagctgaccgacggccagatccaggccatgctgagaagatggttcgtggaggtggagggcaccgtgaaggcctacgtgtgggacaacaacaaggacctggccgagtggctggagaagcagctgaccgaggaggacggcgtgcacagcgtgatcgaggagaacatcaagtgcatcagcagagactacgtgctgaagcagatcagaagcctggtgcaggccaaccccgaggtggccatggacagcatcatccacatgacccagcacatcagccccacccagagagccgaggtgatcagaatcctgagcaccatggacagccccagcacctag

SEQ ID NO: 9233 - DNA, 129 bp, Artificial Sequence
  Description of Artificial Sequence: Synthetic coding sequence
atgagcggcctgcacctggtgaagcagggcagagacagaaagaagatcgacagccagagagacttcaccgtggccagccccgccgagttcgtgaccagattcggcggcaacaaggtgatcgagaagtag

SEQ ID NO: 9234 - DNA, 7041 bp, Artificial Sequence
  Description of Artificial Sequence: Synthetic coding sequence
atggacgagcccagccccctggcccagcccctggagctgaaccagcacagcagattcatcatcggcagcgtgagcgaggacaacagcgaggacgagatcagcaacctggtgaagctggacctgctggaggagaaggagggcagcctgagccccgccagcgtgggcagcgacaccctgagcgacctgggcatcagcagcctgcaggacggcctggccctgcacatcagaagcagcatgagcggcctgcacctggtgaagcagggcagagacagaaagaagatcgacagccagagagacttcaccgtggccagccccgccgagttcgtgaccagattcggcggcaacaaggtgatcgagaaggtgctgatcgccaacaacggcatcgccgccgtgaagtgcatgagaagcatcagaagatggagctacgagatgttcagaaacgagagagccatcagattcgtggtgatggtgacccccgaggacctgaaggccaacgccgagtacatcaagatggccgaccactacgtgcccgtgcccggcggccccaacaacaacaactacgccaacgtggagctgatcctggacatcgccaagagaatccccgtgcaggccgtgtgggccggctggggccacgccagcgagaaccccaagctgcccgagctgctgctgaagaacggcatcgccttcatgggcccccccagccaggccatgtgggccctgggcgacaagatcgccagcagcatcgtggcccagaccgccggcatccccaccctgccctggagcggcagcggcctgagagtggactggcaggagaacgacttcagcaagagaatcctgaacgtgccccaggagctgtacgagaagggctacgtgaaggacgtggacgacggcctgcaggccgccgaggaggtgggctaccccgtgatgatcaaggccagcgagggcggcggcggcaagggcatcagaaaggtgaacaacgccgacgacttccccaacctgttcagacaggtgcaggccgaggtgcccggcagccccatcttcgtgatgagactggccaagcagagcagacacctggaggtgcagatcctggccgaccagtacggcaacgccatcagcctgttcggcagagactgcagcgtgcagagaagacaccagaagatcatcgaggaggcccccgccaccatcgccacccccgccgtgttcgagcacatggagcagtgcgccgtgaagctggccaagatggtgggctacgtgagcgccggcaccgtggagtacctgtacagccaggacggcagcttctacttcctggagctgaaccccagactgcaggtggagcacccctgcaccgagatggtggccgacgtgaacctgcccgccgcccagctgcagatcgccatgggcatccccctgtacagaatcaaggacatcagaatgatgtacggcgtgagcccctggggcgacagccccatcgacttcgaggacagcgcccacgtgccctgccccagaggccacgtgatcgccgccagaatcaccagcgagaaccccgacgagggcttcaagcccagcagcggcaccgtgcaggagctgaacttcagaagcaacaagaacgtgtggggctacttcagcgtggccgccgccggcggcctgcacgagttcgccgacagccagttcggccactgcttcagctggggcgagaacagagaggaggccatcagcaacatggtggtggccctgaaggagctgagcatcagaggcgacttcagaaccaccgtggagtacctgatcaagctgctggagaccgagagcttccagatgaacagaatcgacaccggctggctggacagactgatcgccgagaaggtgcaggccgagagacccgacaccatgctgggcgtggtgtgcggcgccctgcacgtggccgacgtgagcctgagaaacagcgtgagcaacttcctgcacagcctggagagaggccaggtgctgcccgcccacaccctgctgaacaccgtggacgtggagctgatctacgagggcgtgaagtacgtgctgaaggtgaccagacagagccccaacagctacgtggtgatcatgaacggcagctgcgtggaggtggacgtgcacagactgagcgacggcggcctgctgctgagctacgacggcagcagctacaccacctacatgaaggaggaggtggacagatacagaatcaccatcggcaacaagacctgcgtgttcgagaaggagaacgaccccagcgtgatgagaagccccagcgccggcaagctgatccagtacatcgtggaggacggcggccacgtgttcgccggccagtgctacgccgagatcgaggtgatgaagatggtgatgaccctgaccgccgtggagagcggctgcatccactacgtgaagagacccggcgccgccctggaccccggctgcgtgctggccaagatgcagctggacaaccccagcaaggtgcagcaggccgagctgcacaccggcagcctgcccagaatccagagcaccgccctgagaggcgagaagctgcacagagtgttccactacgtgctggacaacctggtgaacgtgatgaacggctactgcctgcccgaccccttcttcagcagcaaggtgaaggactgggtggagagactgatgaagaccctgagagaccccagcctgcccctgctggagctgcaggacatcatgaccagcgtgagcggcagaatcccccccaacgtggagaagagcatcaagaaggagatggcccagtacgccagcaacatcaccagcgtgctgtgccagttccccagccagcagatcgccaacatcctggacagccacgccgccaccctgaacagaaagagcgagagagaggtgttcttcatgaacacccagagcatcgtgcagctggtgcagagatacagaagcggcatcagaggccacatgaaggccgtggtgatggacctgctgagacagtacctgagagtggagacccagttccagaacggccactacgacaagtgcgtgttcgccctgagagaggagaacaagagcgacatgaacaccgtgctgaactacatcttcagccacgcccaggtgaccaagaagaacctgctggtgaccatgctgatcgaccagctgtgcggcagagaccccaccctgaccgacgagctgctgaacatcctgaccgagctgacccagctgagcaagaccaccaacgccaaggtggccctgagagccagacaggtgctgatcgccagccacctgcccagctacgagctgagacacaaccaggtggagagcatcttcctgagcgccatcgacatgtacggccaccagttctgcatcgagaacctgcagaagctgatcctgagcgagaccagcatcttcgacgtgctgcccaacttcttctaccacagcaaccaggtggtgagaatggccgccctggaggtgtacgtgagaagagcctacatcgcctacgagctgaacagcgtgcagcacagacagctgaaggacaacacctgcgtggtggagttccagttcatgctgcccaccagccaccccaacagaggcaacatccccaccctgaacagaatgagcttcagcagcaacctgaaccactacggcatgacccacgtggccagcgtgagcgacgtgctgctggacaacagcttcacccccccctgccagagaatgggcggcatggtgagcttcagaaccttcgaggacttcgtgagaatcttcgacgaggtgatgggctgcttcagcgacagccccccccagagccccaccttccccgaggccggccacaccagcctgtacgacgaggacaaggtgcccagagacgagcccatccacatcctgaacgtggccatcaagaccgactgcgacatcgaggacgacagactggccgccatgttcagagagttcacccagcagaacaaggccaccctggtggaccacggcatcagaagactgaccttcctggtggcccagaaggacttcagaaagcaggtgaactacgaggtggacagaagattccacagagagttccccaagttcttcaccttcagagccagagacaagttcgaggaggacagaatctacagacacctggagcccgccctggccttccagctggagctgaacagaatgagaaacttcgacctgaccgccatcccctgcgccaaccacaagatgcacctgtacctgggcgccgccaaggtggaggtgggcaccgaggtgaccgactacagattcttcgtgagagccatcatcagacacagcgacctggtgaccaaggaggccagcttcgagtacctgcagaacgagggcgagagactgctgctggaggccatggacgagctggaggtggccttcaacaacaccaacgtgagaaccgactgcaaccacatcttcctgaacttcgtgcccaccgtgatcatggaccccagcaagatcgaggagagcgtgagaagcatggtgatgagatacggcagcagactgtggaagctgagagtgctgcaggccgagctgaagatcaacatcagactgacccccaccggcaaggccatccccatcagactgttcctgaccaacgagagcggctactacctggacatcagcctgtacaaggaggtgaccgacagcagaaccgcccagatcatgttccaggcctacggcgacaagcagggccccctgcacggcatgctgatcaacaccccctacgtgaccaaggacctgctgcagagcaagagattccaggcccagagcctgggcaccacctacatctacgacatccccgagatgttcagacagagcctgatcaagctgtgggagagcatgagcacccaggccttcctgcccagcccccccctgcccagcgacatgctgacctacaccgagctggtgctggacgaccagggccagctggtgcacatgaacagactgcccggcggcaacgagatcggcatggtggcctggaagatgaccttcaagagccccgagtaccccgagggcagagacatcatcgtgatcggcaacgacatcacctacagaatcggcagcttcggcccccaggaggacctgctgttcctgagagccagcgagctggccagagccgagggcatccccagaatctacgtgagcgccaacagcggcgccagaatcggcctggccgaggagatcagacacatgttccacgtggcctgggtggaccccgaggacccctacaagggctacagatacctgtacctgaccccccaggactacaagagagtgagcgccctgaacagcgtgcactgcgagcacgtggaggacgagggcgagagcagatacaagatcaccgacatcatcggcaaggaggagggcatcggccccgagaacctgagaggcagcggcatgatcgccggcgagagcagcctggcctacaacgagatcatcaccatcagcctggtgacctgcagagccatcggcatcggcgcctacctggtgagactgggccagagaaccatccaggtggagaacagccacctgatcctgaccggcgccggcgccctgaacaaggtgctgggcagagaggtgtacaccagcaacaaccagctgggcggcatccagatcatgcacaacaacggcgtgacccactgcaccgtgtgcgacgacttcgagggcgtgttcaccgtgctgcactggctgagctacatgcccaagagcgtgcacagcagcgtgcccctgctgaacagcaaggaccccatcgacagaatcatcgagttcgtgcccaccaagaccccctacgaccccagatggatgctggccggcagaccccaccccacccagaagggccagtggctgagcggcttcttcgactacggcagcttcagcgagatcatgcagccctgggcccagaccgtggtggtgggcagagccagactgggcggcatccccgtgggcgtggtggccgtggagaccagaaccgtggagctgagcatccccgccgaccccgccaacctggacagcgaggccaagatcatccagcaggccggccaggtgtggttccccgacagcgccttcaagacctaccaggccatcaaggacttcaacagagagggcctgcccctgatggtgttcgccaactggagaggcttcagcggcggcatgaaggacatgtacgaccaggtgctgaagttcggcgcctacatcgtggacggcctgagagagtgctgccagcccgtgctggtgtacatccccccccaggccgagctgagaggcggcagctgggtggtgatcgacagcagcatcaaccccagacacatggagatgtacgccgacagagagagcagaggcagcgtgctggagcccgagggcaccgtggagatcaagttcagaagaaaggacctggtgaagaccatgagaagagtggaccccgtgtacatccacctggccgagagactgggcacccccgagctgagcaccgccgagagaaaggagctggagaacaagctgaaggagagagaggagttcctgatccccatctaccaccaggtggccgtgcagttcgccgacctgcacgacacccccggcagaatgcaggagaagggcgtgatcagcgacatcctggactggaagaccagcagaaccttcttctactggagactgagaagactgctgctggaggacctggtgaagaagaagatccacaacgccaaccccgagctgaccgacggccagatccaggccatgctgagaagatggttcgtggaggtggagggcaccgtgaaggcctacgtgtgggacaacaacaaggacctggccgagtggctggagaagcagctgaccgaggaggacggcgtgcacagcgtgatcgaggagaacatcaagtgcatcagcagagactacgtgctgaagcagatcagaagcctggtgcaggccaaccccgaggtggccatggacagcatcatccacatgacccagcacatcagccccacccagagagccgaggtgatcagaatcctgagcaccatggacagccccagcacctag

SEQ ID NO: 9235 - DNA, 129 bp, Artificial Sequence; identical to SEQ ID NO: 9233
  Description of Artificial Sequence: Synthetic coding sequence

SEQ ID NO: 9236 - DNA, 234 bp, Artificial Sequence
  Description of Artificial Sequence: Synthetic coding sequence
atggacgagcccagccccctggcccagcccctggagctgaaccagcacagcagattcatcatcggcagcgtgagcgaggacaacagcgaggacgagatcagcaacctggtgaagctggacctgctggaggagaaggagggcagcctgagccccgccagcgtgggcagcgacaccctgagcgacctgggcatcagcagcctgcaggacggcctggccctgcacatcagactgtag

SEQ ID NO: 9237 - DNA, 3138 bp, Artificial Sequence
  Description of Artificial Sequence: Synthetic coding sequence
atgggctgcttcagcgacagccccccccagagccccaccttccccgaggccggccacaccagcctgtacgacgaggacaaggtgcccagagacgagcccatccacatcctgaacgtggccatcaagaccgactgcgacatcgaggacgacagactggccgccatgttcagagagttcacccagcagaacaaggccaccctggtggaccacggcatcagaagactgaccttcctggtggcccagaaggacttcagaaagcaggtgaactacgaggtggacagaagattccacagagagttccccaagttcttcaccttcagagccagagacaagttcgaggaggacagaatctacagacacctggagcccgccctggccttccagctggagctgaacagaatgagaaacttcgacctgaccgccatcccctgcgccaaccacaagatgcacctgtacctgggcgccgccaaggtggaggtgggcaccgaggtgaccgactacagattcttcgtgagagccatcatcagacacagcgacctggtgaccaaggaggccagcttcgagtacctgcagaacgagggcgagagactgctgctggaggccatggacgagctggaggtggccttcaacaacaccaacgtgagaaccgactgcaaccacatcttcctgaacttcgtgcccaccgtgatcatggaccccagcaagatcgaggagagcgtgagaagcatggtgatgagatacggcagcagactgtggaagctgagagtgctgcaggccgagctgaagatcaacatcagactgacccccaccggcaaggccatccccatcagactgttcctgaccaacgagagcggctactacctggacatcagcctgtacaaggaggtgaccgacagcagaaccgcccagatcatgttccaggcctacggcgacaagcagggccccctgcacggcatgctgatcaacaccccctacgtgaccaaggacctgctgcagagcaagagattccaggcccagagcctgggcaccacctacatctacgacatccccgagatgttcagacagatcggcatggtggcctggaagatgaccttcaagagccccgagtaccccgagggcagagacatcatcgtgatcggcaacgacatcacctacagaatcggcagcttcggcccccaggaggacctgctgttcctgagagccagcgagctggccagagccgagggcatccccagaatctacgtgagcgccaacagcggcgccagaatcggcctggccgaggagatcagacacatgttccacgtggcctgggtggaccccgaggacccctacaagggctacagatacctgtacctgaccccccaggactacaagagagtgagcgccctgaacagcgtgcactgcgagcacgtggaggacgagggcgagagcagatacaagatcaccgacatcatcggcaaggaggagggcatcggccccgagaacctgagaggcagcggcatgatcgccggcgagagcagcctggcctacaacgagatcatcaccatcagcctggtgacctgcagagccatcggcatcggcgcctacctggtgagactgggccagagaaccatccaggtggagaacagccacctgatcctgaccggcgccggcgccctgaacaaggtgctgggcagagaggtgtacaccagcaacaaccagctgggcggcatccagatcatgcacaacaacggcgtgacccactgcaccgtgtgcgacgacttcgagggcgtgttcaccgtgctgcactggctgagctacatgcccaagagcgtgcacagcagcgtgcccctgctgaacagcaaggaccccatcgacagaatcatcgagttcgtgcccaccaagaccccctacgaccccagatggatgctggccggcagaccccaccccacccagaagggccagtggctgagcggcttcttcgactacggcagcttcagcgagatcatgcagccctgggcccagaccgtggtggtgggcagagccagactgggcggcatccccgtgggcgtggtggccgtggagaccagaaccgtggagctgagcatccccgccgaccccgccaacctggacagcgaggccaagatcatccagcaggccggccaggtgtggttccccgacagcgccttcaagacctaccaggccatcaaggacttcaacagagagggcctgcccctgatggtgttcgccaactggagaggcttcagcggcggcatgaaggacatgtacgaccaggtgctgaagttcggcgcctacatcgtggacggcctgagagagtgctgccagcccgtgctggtgtacatccccccccaggccgagctgagaggcggcagctgggtggtgatcgacagcagcatcaaccccagacacatggagatgtacgccgacagagagagcagaggcagcgtgctggagcccgagggcaccgtggagatcaagttcagaagaaaggacctggtgaagaccatgagaagagtggaccccgtgtacatccacctggccgagagactgggcacccccgagctgagcaccgccgagagaaaggagctggagaacaagctgaaggagagagaggagttcctgatccccatctaccaccaggtggccgtgcagttcgccgacctgcacgacacccccggcagaatgcaggagaagggcgtgatcagcgacatcctggactggaagaccagcagaaccttcttctactggagactgagaagactgctgctggaggacctggtgaagaagaagatccacaacgccaaccccgagctgaccgacggccagatccaggccatgctgagaagatggttcgtggaggtggagggcaccgtgaaggcctacgtgtgggacaacaacaaggacctggccgagtggctggagaagcagctgaccgaggaggacggcgtgcacagcgtgatcgaggagaacatcaagtgcatcagcagagactacgtgctgaagcagatcagaagcctggtgcaggccaaccccgaggtggccatggacagcatcatccacatgacccagcacatcagccccacccagagagccgaggtgatcagaatcctgagcaccatggacagccccagcacctag

SEQ ID NO: 9238 - DNA, 363 bp, Artificial Sequence
  Description of Artificial Sequence: Synthetic coding sequence
atggacgagcccagccccctggcccagcccctggagctgaaccagcacagcagattcatcatcggcagcgtgagcgaggacaacagcgaggacgagatcagcaacctggtgaagctggacctgctggaggagaaggagggcagcctgagccccgccagcgtgggcagcgacaccctgagcgacctgggcatcagcagcctgcaggacggcctggccctgcacatcagaagcagcatgagcggcctgcacctggtgaagcagggcagagacagaaagaagatcgacagccagagagacttcaccgtggccagccccgccgagttcgtgaccagattcggcggcaacaaggtgatcgagaagtag

SEQ ID NO: 9239 - DNA, 7113 bp, Artificial Sequence
  Description of Artificial Sequence: Synthetic coding sequence
agcttctggaagtggatcagcacccagaccgtgagaatcatcagagccgtgagagcccacttcggcggcatcatggacgagcccagccccctggcccagcccctggagctgaaccagcacagcagattcatcatcggcagcgtgagcgaggacaacagcgaggacgagatcagcaacctggtgaagctggacctgctggaggagaaggagggcagcctgagccccgccagcgtgggcagcgacaccctgagcgacctgggcatcagcagcctgcaggacggcctggccctgcacatcagaagcagcatgagcggcctgcacctggtgaagcagggcagagacagaaagaagatcgacagccagagagacttcaccgtggccagccccgccgagttcgtgaccagattcggcggcaacaaggtgatcgagaaggtgctgatcgccaacaacggcatcgccgccgtgaagtgcatgagaagcatcagaagatggagctacgagatgttcagaaacgagagagccatcagattcgtggtgatggtgacccccgaggacctgaaggccaacgccgagtacatcaagatggccgaccactacgtgcccgtgcccggcggccccaacaacaacaactacgccaacgtggagctgatcctggacatcgccaagagaatccccgtgcaggccgtgtgggccggctggggccacgccagcgagaaccccaagctgcccgagctgctgctgaagaacggcatcgccttcatgggcccccccagccaggccatgtgggccctgggcgacaagatcgccagcagcatcgtggcccagaccgccggcatccccaccctgccctggagcggcagcggcctgagagtggactggcaggagaacgacttcagcaagagaatcctgaacgtgccccaggagctgtacgagaagggctacgtgaaggacgtggacgacggcctgcaggccgccgaggaggtgggctaccccgtgatgatcaaggccagcgagggcggcggcggcaagggcatcagaaaggtgaacaacgccgacgacttccccaacctgttcagacaggtgcaggccgaggtgcccggcagccccatcttcgtgatgagactggccaagcagagcagacacctggaggtgcagatcctggccgaccagtacggcaacgccatcagcctgttcggcagagactgcagcgtgcagagaagacaccagaagatcatcgaggaggcccccgccaccatcgccacccccgccgtgttcgagcacatggagcagtgcgccgtgaagctggccaagatggtgggctacgtgagcgccggcaccgtggagtacctgtacagccaggacggcagcttctacttcctggagctgaaccccagactgcaggtggagcacccctgcaccgagatggtggccgacgtgaacctgcccgccgcccagctgcagatcgccatgggcatccccctgtacagaatcaaggacatcagaatgatgtacggcgtgagcccctggggcgacagccccatcgacttcgaggacagcgcccacgtgccctgccccagaggccacgtgatcgccgccagaatcaccagcgagaaccccgacgagggcttcaagcccagcagcggcaccgtgcaggagctgaacttcagaagcaacaagaacgtgtggggctacttcagcgtggccgccgccggcggcctgcacgagttcgccgacagccagttcggccactgcttcagctggggcgagaacagagaggaggccatcagcaacatggtggtggccctgaaggagctgagcatcagaggcgacttcagaaccaccgtggagtacctgatcaagctgctggagaccgagagcttccagatgaacagaatcgacaccggctggctggacagactgatcgccgagaaggtgcaggccgagagacccgacaccatgctgggcgtggtgtgcggcgccctgcacgtggccgacgtgagcctgagaaacagcgtgagcaacttcctgcacagcctggagagaggccaggtgctgcccgcccacaccctgctgaacaccgtggacgtggagctgatctacgagggcgtgaagtacgtgctgaaggtgaccagacagagccccaacagctacgtggtgatcatgaacggcagctgcgtggaggtggacgtgcacagactgagcgacggcggcctgctgctgagctacgacggcagcagctacaccacctacatgaaggaggaggtggacagatacagaatcaccatcggcaacaagacctgcgtgttcgagaaggagaacgaccccagcgtgatgagaagccccagcgccggcaagctgatccagtacatcgtggaggacggcggccacgtgttcgccggccagtgctacgccgagatcgaggtgatgaagatggtgatgaccctgaccgccgtggagagcggctgcatccactacgtgaagagacccggcgccgccctggaccccggctgcgtgctggccaagatgcagctggacaaccccagcaaggtgcagcaggccgagctgcacaccggcagcctgcccagaatccagagcaccgccctgagaggcgagaagctgcacagagtgttccactacgtgctggacaacctggtgaacgtgatgaacggctactgcctgcccgaccccttcttcagcagcaaggtgaaggactgggtggagagactgatgaagaccctgagagaccccagcctgcccctgctggagctgcaggacatcatgaccagcgtgagcggcagaatcccccccaacgtggagaagagcatcaagaaggagatggcccagtacgccagcaacatcaccagcgtgctgtgccagttccccagccagcagatcgccaacatcctggacagccacgccgccaccctgaacagaaagagcgagagagaggtgttcttcatgaacacccagagcatcgtgcagctggtgcagagatacagaagcggcatcagaggccacatgaaggccgtggtgatggacctgctgagacagtacctgagagtggagacccagttccagaacggccactacgacaagtgcgtgttcgccctgagagaggagaacaagagcgacatgaacaccgtgctgaactacatcttcagccacgcccaggtgaccaagaagaacctgctggtgaccatgctgatcgaccagctgtgcggcagagaccccaccctgaccgacgagctgctgaacatcctgaccgagctgacccagctgagcaagaccaccaacgccaaggtggccctgagagccagacaggtgctgatcgccagccacctgcccagctacgagctgagacacaaccaggtggagagcatcttcctgagcgccatcgacatgtacggccaccagttctgcatcgagaacctgcagaagctgatcctgagcgagaccagcatcttcgacgtgctgcccaacttcttctaccacagcaaccaggtggtgagaatggccgccctggaggtgtacgtgagaagagcctacatcgcctacgagctgaacagcgtgcagcacagacagctgaaggacaacacctgcgtggtggagttccagttcatgctgcccaccagccaccccaacagaggcaacatccccaccctgaacagaatgagcttcagcagcaacctgaaccactacggcatgacccacgtggccagcgtgagcgacgtgctgctggacaacagcttcacccccccctgccagagaatgggcggcatggtgagcttcagaaccttcgaggacttcgtgagaatcttcgacgaggtgatgggctgcttcagcgacagccccccccagagccccaccttccccgaggccggccacaccagcctgtacgacgaggacaaggtgcccagagacgagcccatccacatcctgaacgtggccatcaagaccgactgcgacatcgaggacgacagactggccgccatgttcagagagttcacccagcagaacaaggccaccctggtggaccacggcatcagaagactgaccttcctggtggcccagaaggacttcagaaagcaggtgaactacgaggtggacagaagattccacagagagttccccaagttcttcaccttcagagccagagacaagttcgaggaggacagaatctacagacacctggagcccgccctggccttccagctggagctgaacagaatgagaaacttcgacctgaccgccatcccctgcgccaaccacaagatgcacctgtacctgggcgccgccaaggtggaggtgggcaccgaggtgaccgactacagattcttcgtgagagccatcatcagacacagcgacctggtgaccaaggaggccagcttcgagtacctgcagaacgagggcgagagactgctgctggaggccatggacgagctggaggtggccttcaacaacaccaacgtgagaaccgactgcaaccacatcttcctgaacttcgtgcccaccgtgatcatggaccccagcaagatcgaggagagcgtgagaagcatggtgatgagatacggcagcagactgtggaagctgagagtgctgcaggccgagctgaagatcaacatcagactgacccccaccggcaaggccatccccatcagactgttcctgaccaacgagagcggctactacctggacatcagcctgtacaaggaggtgaccgacagcagaaccgcccagatcatgttccaggcctacggcgacaagcagggccccctgcacggcatgctgatcaacaccccctacgtgaccaaggacctgctgcagagcaagagattccaggcccagagcctgggcaccacctacatctacgacatccccgagatgttcagacagagcctgatcaagctgtgggagagcatgagcacccaggccttcctgcccagcccccccctgcccagcgacatgctgacctacaccgagctggtgctggacgaccagggccagctggtgcacatgaacagactgcccggcggcaacgagatcggcatggtggcctggaagatgaccttcaagagccccgagtaccccgagggcagagacatcatcgtgatcggcaacgacatcacctacagaatcggcagcttcggcccccaggaggacctgctgttcctgagagccagcgagctggccagagccgagggcatccccagaatctacgtgagcgccaacagcggcgccagaatcggcctggccgaggagatcagacacatgttccacgtggcctgggtggaccccgaggacccctacaagggctacagatacctgtacctgaccccccaggactacaagagagtgagcgccctgaacagcgtgcactgcgagcacgtggaggacgagggcgagagcagatacaagatcaccgacatcatcggcaaggaggagggcatcggccccgagaacctgagaggcagcggcatgatcgccggcgagagcagcctggcctacaacgagatcatcaccatcagcctggtgacctgcagagccatcggcatcggcgcctacctggtgagactgggccagagaaccatccaggtggagaacagccacctgatcctgaccggcgccggcgccctgaacaaggtgctgggcagagaggtgtacaccagcaacaaccagctgggcggcatccagatcatgcacaacaacggcgtgacccactgcaccgtgtgcgacgacttcgagggcgtgttcaccgtgctgcactggctgagctacatgcccaagagcgtgcacagcagcgtgcccctgctgaacagcaaggaccccatcgacagaatcatcgagttcgtgcccaccaagaccccctacgaccccagatggatgctggccggcagaccccaccccacccagaagggccagtggctgagcggcttcttcgactacggcagcttcagcgagatcatgcagccctgggcccagaccgtggtggtgggcagagccagactgggcggcatccccgtgggcgtggtggccgtggagaccagaaccgtggagctgagcatccccgccgaccccgccaacctggacagcgaggccaagatcatccagcaggccggccaggtgtggttccccgacagcgccttcaagacctaccaggccatcaaggacttcaacagagagggcctgcccctgatggtgttcgccaactggagaggcttcagcggcggcatgaaggacatgtacgaccaggtgctgaagttcggcgcctacatcgtggacggcctgagagagtgctgccagcccgtgctggtgtacatccccccccaggccgagctgagaggcggcagctgggtggtgatcgacagcagcatcaaccccagacacatggagatgtacgccgacagagagagcagaggcagcgtgctggagcccgagggcaccgtggagatcaagttcagaagaaaggacctggtgaagaccatgagaagagtggaccccgtgtacatccacctggccgagagactgggcacccccgagctgagcaccgccgagagaaaggagctggagaacaagctgaaggagagagaggagttcctgatccccatctaccaccaggtggccgtgcagttcgccgacctgcacgacacccccggcagaatgcaggagaagggcgtgatcagcgacatcctggactggaagaccagcagaaccttcttctactggagactgagaagactgctgctggaggacctggtgaagaagaagatccacaacgccaaccccgagctgaccgacggccagatccaggccatgctgagaagatggttcgtggaggtggagggcaccgtgaaggcctacgtgtgggacaacaacaaggacctggccgagtggctggagaagcagctgaccgaggaggacggcgtgcacagcgtgatcgaggagaacatcaagtgcatcagcagagactacgtgctgaagcagatcagaagcctggtgcaggccaaccccgaggtggccatggacagcatcatccacatgacccagcacatcagccccacccagagagccgaggtgatcagaatcctgagcaccatggacagccccagcacctag

SEQ ID NO: 9240 - DNA, 777 bp, Artificial Sequence
  Description of Artificial Sequence: Synthetic coding sequence
atgagcggcctgcacctggtgaagcagggcagagacagaaagaagatcgacagccagagagacttcaccgtggccagccccgccgagttcgtgaccagattcggcggcaacaaggtgatcgagaaggtgctgatcgccaacaacggcatcgccgccgtgaagtgcatgagaagcatcagaagatggagctacgagatgttcagaaacgagagagccatcagattcgtggtgatggtgacccccgaggacctgaaggccaacgccgagtacatcaagatggccgaccactacgtgcccgtgcccggcggccccaacaacaacaactacgccaacgtggagctgatcctggacatcgccaagagaatccccgtgcaggccgtgtgggccggctggggccacgccagcgagaaccccaagctgcccgagctgctgctgaagaacggcatcgccttcatgggcccccccagccaggccatgtgggccctgggcgacaagatcgccagcagcatcgtggcccagaccgccggcatccccaccctgccctggagcggcagcggcctgagagtggactggcaggagaacgacttcagcaagagaatcctgaacgtgccccaggagctgtacgagaagggctacgtgaaggacgtggacgacggcctgcaggccgccgaggaggtgggctaccccgtgatgatcaaggccagcgagggcggcggcggcaagggcatcagaaaggtgaacaacgccgacgacttccccaacctgttcagacagtag

SEQ ID NO: 9241 - DNA, 144 bp, Artificial Sequence
  Description of Artificial Sequence: Synthetic coding sequence
atggacgagcccagccccctggcccagcccctggagctgaaccagcacagcagattcatcatcggcagcgtgagcgaggacaacagcgaggacgagatcagcaacctggtgaagctggacctgctggaggagaaggagggctag

SEQ ID NO: 9242 - DNA, 2679 bp, Artificial Sequence
  Description of Artificial Sequence: Synthetic coding sequence
atggaccactacgacagccagcagaccaacgactacatgcagcccgaggaggactgggacagagacctgctgctggaccccgcctgggagaagcagcagagaaagaccttcaccgcctggtgcaacagccacctgagaaaggccggcacccagatcgagaacatcgaggaggacttcagagacggcctgaagctgatgctgctgctggaggtgatcagcggcgagagactggccaagcccgagagaggcaagatgagagtgcacaagatcagcaacgtgaacaaggccctggacttcatcgccagcaagggcgtgaagctggtgagcatcggcgccgaggagatcgtggacggcaacgtgaagatgaccctgggcatgatctggaccatcatcctgagattcgccatccaggacatcagcgtggaggagaccagcgccaaggagggcctgctgctgtggtgccagagaaagaccgccccctacaagaacgtgaacatccagaacttccacatcagctggaaggacggcctgggcttctgcgccctgatccacagacacagacccgagctgatcgactacggcaagctgagaaaggacgaccccctgaccaacctgaacaccgccttcgacgtggccgagaagtacctggacatccccaagatgctggacgccgaggacatcgtgggcaccgccagacccgacgagaaggccatcatgacctacgtgagcagcttctaccacgccttcagcggcgcccagaaggccgagaccgccgccaacagaatctgcaaggtgctggccgtgaaccaggagaacgagcagctgatggaggactacgagaagctggccagcgacctgctggagtggatcagaagaaccatcccctggctggagaacagagtgcccgagaacaccatgcacgccatgcagcagaagctggaggacttcagagactacagaagactgcacaagccccccaaggtgcaggagaagtgccagctggagatcaacttcaacaccctgcagaccaagctgagactgagcaacagacccgccttcatgcccagcgagggcagaatggtgagcgacatcaacaacgcctggggctgcctggagcaggtggagaagggctacgaggagtggctgctgaacgagatcagaagactggagagactggaccacctggccgagaagttcagacagaaggccagcatccacgaggcctggaccgacggcaaggaggccatgctgagacagaaggactacgagaccgccaccctgagcgagatcaaggccctgctgaagaagcacgaggccttcgagagcgacctggccgcccaccaggacagagtggagcagatcgccgccatcgcccaggagctgaacgagctggactactacgacagccccagcgtgaacgccagatgccagaagatctgcgaccagtgggacaacctgggcgccctgacccagaagagaagagaggccctggagagaaccgagaagctgctggagaccatcgaccagctgtacctggagtacgccaagagagccgcccccttcaacaactggatggagggcgccatggaggacctgcaggacaccttcatcgtgcacaccatcgaggagatccagggcctgaccaccgcccacgagcagttcaaggccaccctgcccgacgccgacaaggagagactggccatcctgggcatccacaacgaggtgagcaagatcgtgcagacctaccacgtgaacatggccggcaccaacccctacaccaccatcaccccccaggagatcaacggcaagtgggaccacgtgagacagctggtgcccagaagagaccaggccctgaccgaggagcacgccagacagcagcacaacgagagactgagaaagcagttcggcgcccaggccaacgtgatcggcccctggatccagaccaagatggaggagatcggcagaatcagcatcgagatgcacggcaccctggaggaccagctgagccacctgagacagtacgagaagagcatcgtgaactacaagcccaagatcgaccagctggagggcgaccaccagctgatccaggaggccctgatcttcgacaacaagcacaccaactacaccatggagcacatcagagtgggctgggagcagctgctgaccaccatcgccagaaccatcaacgaggtggagaaccagatcctgaccagagacgccaagggcatcagccaggagcagatgaacgagttcagagccagcttcaaccacttcgacagagaccacagcggcaccctgggccccgaggagttcaaggcctgcctgatcagcctgggctacgacatcggcaacgacccccagggcgaggccgagttcgccagaatcatgagcatcgtggaccccaacagactgggcgtggtgaccttccaggccttcatcgacttcatgagcagagagaccgccgacaccgacaccgccgaccaggtgatggccagcttcaagatcctggccggcgacaagaactacatcaccatggacgagctgagaagagagctgccccccgaccaggccgagtactgcatcgccagaatggccccctacaccggccccgacagcgtgcccggcgccctggactacatgagcttcagcaccgccctgtacggcgagagcgacctgtag

SEQ ID NO: 9243 - DNA, 2745 bp, Artificial Sequence
  Description of Artificial Sequence: Synthetic coding sequence
atggaccactacgacagccagcagaccaacgactacatgcagcccgaggaggactgggacagagacctgctgctggaccccgcctgggagaagcagcagagaaagaccttcaccgcctggtgcaacagccacctgagaaaggccggcacccagatcgagaacatcgaggaggacttcagagacggcctgaagctgatgctgctgctggaggtgatcagcggcgagagactggccaagcccgagagaggcaagatgagagtgcacaagatcagcaacgtgaacaaggccctggacttcatcgccagcaagggcgtgaagctggtgagcatcggcgccgaggagatcgtggacggcaacgtgaagatgaccctgggcatgatctggaccatcatcctgagattcgccatccaggacatcagcgtggaggagaccagcgccaaggagggcctgctgctgtggtgccagagaaagaccgccccctacaagaacgtgaacatccagaacttccacatcagctggaaggacggcctgggcttctgcgccctgatccacagacacagacccgagctgatcgactacggcaagctgagaaaggacgaccccctgaccaacctgaacaccgccttcgacgtggccgagaagtacctggacatccccaagatgctggacgccgaggacatcgtgggcaccgccagacccgacgagaaggccatcatgacctacgtgagcagcttctaccacgccttcagcggcgcccagaaggccgagaccgccgccaacagaatctgcaaggtgctggccgtgaaccaggagaacgagcagctgatggaggactacgagaagctggccagcgacctgctggagtggatcagaagaaccatcccctggctggagaacagagtgcccgagaacaccatgcacgccatgcagcagaagctggaggacttcagagactacagaagactgcacaagccccccaaggtgcaggagaagtgccagctggagatcaacttcaacaccctgcagaccaagctgagactgagcaacagacccgccttcatgcccagcgagggcagaatggtgagcgacatcaacaacgcctggggctgcctggagcaggtggagaagggctacgaggagtggctgctgaacgagatcagaagactggagagactggaccacctggccgagaagttcagacagaaggccagcatccacgaggcctggaccgacggcaaggaggccatgctgagacagaaggactacgagaccgccaccctgagcgagatcaaggccctgctgaagaagcacgaggccttcgagagcgacctggccgcccaccaggacagagtggagcagatcgccgccatcgcccaggagctgaacgagctggactactacgacagccccagcgtgaacgccagatgccagaagatctgcgaccagtgggacaacctgggcgccctgacccagaagagaagagaggccctggagagaaccgagaagctgctggagaccatcgaccagctgtacctggagtacgccaagagagccgcccccttcaacaactggatggagggcgccatggaggacctgcaggacaccttcatcgtgcacaccatcgaggagatccagggcctgaccaccgcccacgagcagttcaaggccaccctgcccgacgccgacaaggagagactggccatcctgggcatccacaacgaggtgagcaagatcgtgcagacctaccacgtgaacatggccggcaccaacccctacaccaccatcaccccccaggagatcaacggcaagtgggaccacgtgagacagctggtgcccagaagagaccaggccctgaccgaggagcacgccagacagcagcacaacgagagactgagaaagcagttcggcgcccaggccaacgtgatcggcccctggatccagaccaagatggaggagatcggcagaatcagcatcgagatgcacggcaccctggaggaccagctgagccacctgagacagtacgagaagagcatcgtgaactacaagcccaagatcgaccagctggagggcgaccaccagctgatccaggaggccctgatcttcgacaacaagcacaccaactacaccatggagcacatcagagtgggctgggagcagctgctgaccaccatcgccagaaccatcaacgaggtggagaaccagatcctgaccagagacgccaagggcatcagccaggagcagatgaacgagttcagagccagcttcaaccacttcgacagagaccacagcggcaccctgggccccgaggagttcaaggcctgcctgatcagcctgggctacgacatcggcaacgacccccagaagaagaccggcatgatggacaccgacgacttcagagcctgcctgatcagcatgggctacaacatgggcgaggccgagttcgccagaatcatgagcatcgtggaccccaacagactgggcgtggtgaccttccaggccttcatcgacttcatgagcagagagaccgccgacaccgacaccgccgaccaggtgatggccagcttcaagatcctggccggcgacaagaactacatcaccatggacgagctgagaagagagctgccccccgaccaggccgagtactgcatcgccagaatggccccctacaccggccccgacagcgtgcccggcgccctggactacatgagcttcagcaccgccctgtacggcgagagcgacctgtag

SEQ ID NO: 9244 - DNA, 2664 bp, Artificial Sequence
  Description of Artificial Sequence: Synthetic coding sequence
atggaccactacgacagccagcagaccaacgactacatgcagcccgaggaggactgggacagagacctgctgctggaccccgcctgggagaagcagcagagaaagaccttcaccgcctggtgcaacagccacctgagaaaggccggcacccagatcgagaacatcgaggaggacttcagagacggcctgaagctgatgctgctgctggaggtgatcagcggcgagagactggccaagcccgagagaggcaagatgagagtgcacaagatcagcaacgtgaacaaggccctggacttcatcgccagcaagggcgtgaagctggtgagcatcggcgccgaggagatcgtggacggcaacgtgaagatgaccctgggcatgatctggaccatcatcctgagattcgccatccaggacatcagcgtggaggagaccagcgccaaggagggcctgctgctgtggtgccagagaaagaccgccccctacaagaacgtgaacatccagaacttccacatcagctggaaggacggcctgggcttctgcgccctgatccacagacacagacccgagctgatcgactacggcaagctgagaaaggacgaccccctgaccaacctgaacaccgccttcgacgtggccgagaagtacctggacatccccaagatgctggacgccgaggacatcgtgggcaccgccagacccgacgagaaggccatcatgacctacgtgagcagcttctaccacgccttcagcggcgcccagaaggccgagaccgccgccaacagaatctgcaaggtgctggccgtgaaccaggagaacgagcagctgatggaggactacgagaagctggccagcgacctgctggagtggatcagaagaaccatcccctggctggagaacagagtgcccgagaacaccatgcacgccatgcagcagaagctggaggacttcagagactacagaagactgcacaagccccccaaggtgcaggagaagtgccagctggagatcaacttcaacaccctgcagaccaagctgagactgagcaacagacccgccttcatgcccagcgagggcagaatggtgagcgacatcaacaacgcctggggctgcctggagcaggtggagaagggctacgaggagtggctgctgaacgagatcagaagactggagagactggaccacctggccgagaagttcagacagaaggccagcatccacgaggcctggaccgacggcaaggaggccatgctgagacagaaggactacgagaccgccaccctgagcgagatcaaggccctgctgaagaagcacgaggccttcgagagcgacctggccgcccaccaggacagagtggagcagatcgccgccatcgcccaggagctgaacgagctggactactacgacagccccagcgtgaacgccagatgccagaagatctgcgaccagtgggacaacctgggcgccctgacccagaagagaagagaggccctggagagaaccgagaagctgctggagaccatcgaccagctgtacctggagtacgccaagagagccgcccccttcaacaactggatggagggcgccatggaggacctgcaggacaccttcatcgtgcacaccatcgaggagatccagggcctgaccaccgcccacgagcagttcaaggccaccctgcccgacgccgacaaggagagactggccatcctgggcatccacaacgaggtgagcaagatcgtgcagacctaccacgtgaacatggccggcaccaacccctacaccaccatcaccccccaggagatcaacggcaagtgggaccacgtgagacagctggtgcccagaagagaccaggccctgaccgaggagcacgccagacagcagcacaacgagagactgagaaagcagttcggcgcccaggccaacgtgatcggcccctggatccagaccaagatggaggagatcggcagaatcagcatcgagatgcacggcaccctggaggaccagctgagccacctgagacagtacgagaagagcatcgtgaactacaagcccaagatcgaccagctggagggcgaccaccagctgatccaggaggccctgatcttcgacaacaagcacaccaactacaccatggagcacatcagagtgggctgggagcagctgctgaccaccatcgccagaaccatcaacgaggtggagaaccagatcctgaccagagacgccaagggcatcagccaggagcagatgaacgagttcagagccagcttcaaccacttcgacagaaagaagaccggcatgatggacaccgacgacttcagagcctgcctgatcagcatgggctacaacatgggcgaggccgagttcgccagaatcatgagcatcgtggaccccaacagactgggcgtggtgaccttccaggccttcatcgacttcatgagcagagagaccgccgacaccgacaccgccgaccaggtgatggccagcttcaagatcctggccggcgacaagaactacatcaccatggacgagctgagaagagagctgccccccgaccaggccgagtactgcatcgccagaatggccccctacaccggccccgacagcgtgcccggcgccctggactacatgagcttcagcaccgccctgtacggcgagagcgacctgtag

SEQ ID NO: 9245 - DNA, 2736 bp, Artificial Sequence
  Description of Artificial Sequence: Synthetic coding sequence
atggtggactaccacgccgccaaccagagctaccagtacggccccagcagcgccggcaacggcgccggcggcggcggcagcatgggcgactacatggcccaggaggacgactgggacagagacctgctgctggaccccgcctgggagaagcagcagagaaagaccttcaccgcctggtgcaacagccacctgagaaaggccggcacccagatcgagaacatcgacgaggacttcagagacggcctgaagctgatgctgctgctggaggtgatcagcggcgagagactgcccaagcccgagagaggcaagatgagagtgcacaagatcaacaacgtgaacaaggccctggacttcatcgccagcaagggcgtgaagctggtgagcatcggcgccgaggagatcgtggacggcaacgccaagatgaccctgggcatgatctggaccatcatcctgagattcgccatccaggacatcagcgtggaggagaccagcgccaaggagggcctgctgctgtggtgccagagaaagaccgccccctacaagaacgtgaacgtgcagaacttccacatcagctggaaggacggcctggccttcaacgccctgatccacagacacagacccgagctgatcgagtacgacaagctgagaaaggacgaccccgtgaccaacctgaacaacgccttcgaggtggccgagaagtacctggacatccccaagatgctggacgccgaggacatcgtgaacaccgccagacccgacgagaaggccatcatgacctacgtgagcagcttctaccacgccttcagcggcgcccagaaggccgagaccgccgccaacagaatctgcaaggtgctggccgtgaaccaggagaacgagcacctgatggaggactacgagaagctggccagcgacctgctggagtggatcagaagaaccatcccctggctggaggacagagtgccccagaagaccatccaggagatgcagcagaagctggaggacttcagagactacagaagagtgcacaagccccccaaggtgcaggagaagtgccagctggagatcaacttcaacaccctgcagaccaagctgagactgagcaacagacccgccttcatgcccagcgagggcaagatggtgagcgacatcaacaacggctggcagcacctggagcaggccgagaagggctacgaggagtggctgctgaacgagatcagaagactggagagactggaccacctggccgagaagttcagacagaaggccagcatccacgaggcctggaccgacggcaaggaggccatgctgaagcacagagactacgagaccgccaccctgagcgacatcaaggccctgatcagaaagcacgaggccttcgagagcgacctggccgcccaccaggacagagtggagcagatcgccgccatcgcccaggagctgaacgagctggactactacgacagccacaacgtgaacaccagatgccagaagatctgcgaccagtgggacgccctgggcagcctgacccacagcagaagagaggccctggagaagaccgagaagcagctggaggccatcgaccagctgcacctggagtacgccaagagagccgcccccttcaacaactggatggagagcgccatggaggacctgcaggacatgttcatcgtgcacaccatcgaggagatcgagggcctgatcagcgcccacgaccagttcaagagcaccctgcccgacgccgacagagagagagaggccatcctggccatccacaaggaggcccagagaatcgccgagagcaaccacatcaagctgagcggcagcaacccctacaccaccgtgaccccccagatcatcaacagcaagtgggagaaggtgcagcagctggtgcccaagagagaccacgccctgctggaggagcagagcaagcagcagagcaacgagcacctgagaagacagttcgccagccaggccaacgtggtgggcccctggatccagaccaagatggaggagatcggcagaatcagcatcgagatgaacggcaccctggaggaccagctgagccacctgaagcagtacgagagaagcatcgtggactacaagcccaacctggacctgctggagcagcagcaccagctgatccaggaggccctgatcttcgacaacaagcacaccaactacaccatggagcacatcagagtgggctgggagcagctgctgaccaccatcgccagaaccatcaacgaggtggagaaccagatcctgaccagagacgccaagggcatcagccaggagcagatgcaggagttcagagccagcttcaaccacttcgacaaggaccacggcggcgccctgggccccgaggagttcaaggcctgcctgatcagcctgggctacgacgtggagaacgacagacagggcgaggccgagttcaacagaatcatgagcctggtggaccccaaccacagcggcctggtgaccttccaggccttcatcgacttcatgagcagagagaccaccgacaccgacaccgccgaccaggtgatcgccagcttcaaggtgctggccggcgacaagaacttcatcaccgccgaggagctgagaagagagctgccccccgaccaggccgagtactgcatcgccagaatggccccctaccagggccccgacgccgtgcccggcgccctggactacaagagcttcagcaccgccctgtacggcgagagcgacctgtag

SEQ ID NO: 9246 - DNA, 2079 bp, Artificial Sequence
  Description of Artificial Sequence: Synthetic coding sequence
atggtggactaccacgccgccaaccagagctaccagtacggccccagcagcgccggcaacggcgccggcggcggcggcagcatgggcgactacatggcccaggaggacgactgggacagagacctgctgctggaccccgcctgggagaagcagcagagaaaggccgagaccgccgccaacagaatctgcaaggtgctggccgtgaaccaggagaacgagcacctgatggaggactacgagaagctggccagcgacctgctggagtggatcagaagaaccatcccctggctggaggacagagtgccccagaagaccatccaggagatgcagcagaagctggaggacttcagagactacagaagagtgcacaagccccccaaggtgcaggagaagtgccagctggagatcaacttcaacaccctgcagaccaagctgagactgagcaacagacccgccttcatgcccagcgagggcaagatggtgagcgacatcaacaacggctggcagcacctggagcaggccgagaagggctacgaggagtggctgctgaacgagatcagaagactggagagactggaccacctggccgagaagttcagacagaaggccagcatccacgaggcctggaccgacggcaaggaggccatgctgaagcacagagactacgagaccgccaccctgagcgacatcaaggccctgatcagaaagcacgaggccttcgagagcgacctggccgcccaccaggacagagtggagcagatcgccgccatcgcccaggagctgaacgagctggactactacgacagccacaacgtgaacaccagatgccagaagatctgcgaccagtgggacgccctgggcagcctgacccacagcagaagagaggccctggagaagaccgagaagcagctggaggccatcgaccagctgcacctggagtacgccaagagagccgcccccttcaacaactggatggagagcgccatggaggacctgcaggacatgttcatcgtgcacaccatcgaggagatcgagggcctgatcagcgcccacgaccagttcaagagcaccctgcccgacgccgacagagagagagaggccatcctggccatccacaaggaggcccagagaatcgccgagagcaaccacatcaagctgagcggcagcaacccctacaccaccgtgaccccccagatcatcaacagcaagtgggagaaggtgcagcagctggtgcccaagagagaccacgccctgctggaggagcagagcaagcagcagagcaacgagcacctgagaagacagttcgccagccaggccaacgtggtgggcccctggatccagaccaagatggaggagatcggcagaatcagcatcgagatgaacggcaccctggaggaccagctgagccacctgaagcagtacgagagaagcatcgtggactacaagcccaacctggacctgctggagcagcagcaccagctgatccaggaggccctgatcttcgacaacaagcacaccaactacaccatggagcacatcagagtgggctgggagcagctgctgaccaccatcgccagaaccatcaacgaggtggagaaccagatcctgaccagagacgccaagggcatcagccaggagcagatgcaggagttcagagccagcttcaaccacttcgacaaggaccacggcggcgccctgggccccgaggagttcaaggcctgcctgatcagcctgggctacgacgtggagaacgacagacagggcgaggccgagttcaacagaatcatgagcctggtggaccccaaccacagcggcctggtgaccttccaggccttcatcgacttcatgagcagagagaccaccgacaccgacaccgccgaccaggtgatcgccagcttcaaggtgctggccggcgacaagaacttcatcaccgccgaggagctgagaagagagctgccccccgaccaggccgagtactgcatcgccagaatggccccctaccagggccccgacgccgtgcccggcgccctggactacaagagcttcagcaccgccctgtacggcgagagcgacctgtag

SEQ ID NO: 9247 - DNA, 1566 bp, Artificial Sequence
  Description of Artificial Sequence: Synthetic coding sequence
atggtggactaccacgccgccaaccagagctaccagtacggccccagcagcgccggcaacggcgccggcggcggcggcagcatgggcgactacatggcccaggaggacgactgggacagagacctgctgctggaccccgcctgggagaagcagcagagaaagaccttcaccgcctggtgcaacagccacctgagaaaggccggcacccagatcgagaacatcgacgaggacttcagagacggcctgaagctgatgctgctgctggaggtgcacgagctggactactacgacagccacaacgtgaacaccagatgccagaagatctgcgaccagtgggacgccctgggcagcctgacccacagcagaagagaggccctggagaagaccgagaagcagctggaggccatcgaccagctgcacctggagtacgccaagagagccgcccccttcaacaactggatggagagcgccatggaggacctgcaggacatgttcatcgtgcacaccatcgaggagatcgagggcctgatcagcgcccacgaccagttcaagagcaccctgcccgacgccgacagagagagagaggccatcctggccatccacaaggaggcccagagaatcgccgagagcaaccacatcaagctgagcggcagcaacccctacaccaccgtgaccccccagatcatcaacagcaagtgggagaaggtgcagcagctggtgcccaagagagaccacgccctgctggaggagcagagcaagcagcagagcaacgagcacctgagaagacagttcgccagccaggccaacgtggtgggcccctggatccagaccaagatggaggagatcggcagaatcagcatcgagatgaacggcaccctggaggaccagctgagccacctgaagcagtacgagagaagcatcgtggactacaagcccaacctggacctgctggagcagcagcaccagctgatccaggaggccctgatcttcgacaacaagcacaccaactacaccatggagcacatcagagtgggctgggagcagctgctgaccaccatcgccagaaccatcaacgaggtggagaaccagatcctgaccagagacgccaagggcatcagccaggagcagatgcaggagttcagagccagcttcaaccacttcgacaaggaccacggcggcgccctgggccccgaggagttcaaggcctgcctgatcagcctgggctacgacgtggagaacgacagacagggcgaggccgagttcaacagaatcatgagcctggtggaccccaaccacagcggcctggtgaccttccaggccttcatcgacttcatgagcagagagaccaccgacaccgacaccgccgaccaggtgatcgccagcttcaaggtgctggccggcgacaagaacttcatcaccgccgaggagctgagaagagagctgccccccgaccaggccgagtactgcatcgccagaatggccccctaccagggccccgacgccgtgcccggcgccctggactacaagagcttcagcaccgccctgtacggcgagagcgacctgtag

SEQ ID NO: 9248 - DNA, 1689 bp, Artificial Sequence
  Description of Artificial Sequence: Synthetic coding sequence
atggtggactaccacgccgccaaccagagctaccagtacggccccagcagcgccggcaacggcgccggcggcggcggcagcatgggcgactacatggcccaggaggacgactgggacagagacctgctgctggaccccgcctgggagaagcagcagagaaagaccttcaccgcctggtgcaacagccacctgagaaaggccggcacccagatcgagaacatcgacgaggacttcagagacggcctgaagctgatgctgctgctggaggtgatcagcggcgagagactgcccaagcccgagagaggcaagatgagagtgcacaagatcaacaacgtgaacaaggccctggacttcatcgccagcaagggcgtgaagctggtgagcatcggcgccgaggagatcgtggacggcaacgccaagatgaccctgggcatgatctggaccatcatcctgagattcgccatccaggacatcagcgtggaggagaccagcgccaaggagggcctgctgctgtggtgccagagaaagaccgccccctacaagaacgtgaacgtgcagaacttccacatcagctggaaggacggcctggccttcaacgccctgatccacagacacagacccgagctgatcgagtacgacaagctgagaaaggacgaccccgtgaccaacctgaacaacgccttcgaggtggccgagaagtacctggacatccccaagatgctggacgccgaggacatcgtgaacaccgccagacccgacgagaaggccatcatgacctacgtgagcagcttctaccacgccttcagcggcgcccagaaggccgagaccgccgccaacagaatctgcaaggtgctggccgtgaaccaggagaacgagcacctgatggaggactacgagaagctggccagcgacctgctggagtggatcagaagaaccatcccctggctggaggacagagtgccccagaagaccatccaggagatgcagcagaagctggaggacttcagagactacagaagagtgcacaagccccccaaggtgcaggagaagtgccagctggagatcaacttcaacaccctgcagaccaagctgagactgagcaacagacccgccttcatgcccagcgagggcaagatggtgagcgacatcaacaacggctggcagcacctggagcaggccgagaagggctacgaggagtggctgctgaacgagatcagaagactggagagactggaccacctggccgagaagttcagacagaaggccagcatccacgaggcctggaccgacggcaaggaggccatgctgaagcacagagactacgagaccgccaccctgagcgacatcaaggccctgatcagaaagcacgaggccttcgagagcgacctggccgcccaccaggacagagtggagcagatcgccgccatcgcccaggagctgaacgagctggactactacgacagccacaacgtgaacacccccgacggcctgcaggagggccccggccagccccacagccccatcccccccctgtgcatctacgccaagcacagcctgcagagcagcggcgtgggcggctgggccggcagaggctggggcagactgagccccctgagcctgtgcggcctggccagaagattccccagacccggctggggcgacctgggccccgccctgctggtgtggtag

SEQ ID NO: 9249 - DNA, 1518 bp, Artificial Sequence
  Description of Artificial Sequence: Synthetic coding sequence
atgaagttcaagctgcacgtgaacagcgccagacagtacaaggacctgtggaacatgagcgacgacaagcccttcctgtgcaccgcccccggctgcggccagagattcaccaacgaggaccacctggccgtgcacaagcacaagcacgagatgaccctgaagttcggccccgccagaaacgacagcgtgatcgtggccgaccagacccccacccccaccagattcctgaagaactgcgaggaggtgggcctgttcaacgagctggccagccccttcgagaacgagttcaagaaggccagcgaggacgacatcaagaagatgcccctggacctgagccccctggccacccccatcatcagaagcaagatcgaggagcccagcgtggtggagaccacccaccaggacagccccctgccccaccccgagagcaccaccagcgacgagaaggaggtgcccctggcccagaccgcccagcccaccagcgccatcgtgagacccgccagcctgcaggtgcccaacgtgctgctgaccagcagcgacagcagcgtgatcatccagcaggccgtgcccagccccaccagcagcaccgtgatcacccaggcccccagcagcaacagacccatcgtgcccgtgcccggccccttccccctgctgctgcacctgcccaacggccagaccatgcccgtggccatccccgccagcatcaccagcagcaacgtgcacgtgcccgccgccgtgcccctggtgagacccgtgaccatggtgcccagcgtgcccggcatccccggccccagcagcccccagcccgtgcagagcgaggccaagatgagactgaaggccgccctgacccagcagcacccccccgtgaccaacggcgacaccgtgaagggccacggcagcggcctggtgagaacccagagcgaggagagcagaccccagagcctgcagcagcccgccaccagcaccaccgagacccccgccagccccgcccacaccaccccccagacccagagcaccagcggcagaagaagaagagccgccaacgaggaccccgacgagaagagaagaaagttcctggagagaaacagagccgccgccagcagatgcagacagaagagaaaggtgtgggtgcagagcctggagaagaaggccgaggacctgagcagcctgaacggccagctgcagagcgaggtgaccctgctgagaaacgaggtggcccagctgaagcagctgctgctggcccacaaggactgccccgtgaccgccatgcagaagaagagcggctaccacaccgccgacaaggacgacagcagcgaggacatcagcgtgcccagcagcccccacaccgaggccatccagcacagcagcgtgagcaccagcaacggcgtgagcagcaccagcaaggccgaggccgtggccaccagcgtgctgacccagatggccgaccagagcaccgagcccgccctgagccagatcgtgatggcccccagcagccagagccagcccagcggcagctag

SEQ ID NO: 9250 - DNA, 1344 bp, Artificial Sequence
  Description of Artificial Sequence: Synthetic coding sequence
atgtactgcgcctggatgtggcccgaccagacccccacccccaccagattcctgaagaactgcgaggaggtgggcctgttcaacgagctggccagccccttcgagaacgagttcaagaaggccagcgaggacgacatcaagaagatgcccctggacctgagccccctggccacccccatcatcagaagcaagatcgaggagcccagcgtggtggagaccacccaccaggacagccccctgccccaccccgagagcaccaccagcgacgagaaggaggtgcccctggcccagaccgcccagcccaccagcgccatcgtgagacccgccagcctgcaggtgcccaacgtgctgctgaccagcagcgacagcagcgtgatcatccagcaggccgtgcccagccccaccagcagcaccgtgatcacccaggcccccagcagcaacagacccatcgtgcccgtgcccggccccttccccctgctgctgcacctgcccaacggccagaccatgcccgtggccatccccgccagcatcaccagcagcaacgtgcacgtgcccgccgccgtgcccctggtgagacccgtgaccatggtgcccagcgtgcccggcatccccggccccagcagcccccagcccgtgcagagcgaggccaagatgagactgaaggccgccctgacccagcagcacccccccgtgaccaacggcgacaccgtgaagggccacggcagcggcctggtgagaacccagagcgaggagagcagaccccagagcctgcagcagcccgccaccagcaccaccgagacccccgccagccccgcccacaccaccccccagacccagagcaccagcggcagaagaagaagagccgccaacgaggaccccgacgagaagagaagaaagttcctggagagaaacagagccgccgccagcagatgcagacagaagagaaaggtgtgggtgcagagcctggagaagaaggccgaggacctgagcagcctgaacggccagctgcagagcgaggtgaccctgctgagaaacgaggtggcccagctgaagcagctgctgctggcccacaaggactgccccgtgaccgccatgcagaagaagagcggctaccacaccgccgacaaggacgacagcagcgaggacatcagcgtgcccagcagcccccacaccgaggccatccagcacagcagcgtgagcaccagcaacggcgtgagcagcaccagcaaggccgaggccgtggccaccagcgtgctgacccagatggccgaccagagcaccgagcccgccctgagccagatcgtgatggcccccagcagccagagccagcccagcggcagctag

SEQ ID NO: 9251 - DNA, 381 bp, Artificial Sequence
  Description of Artificial Sequence: Synthetic coding sequence
atgagcgacgacaagcccttcctgtgcaccgcccccggctgcggccagagcgaggtgaccctgctgagaaacgaggtggcccagctgaagcagctgctgctggcccacaaggactgccccgtgaccgccatgcagaagaagagcggctaccacaccgccgacaaggacgacagcagcgaggacatcagcgtgcccagcagcccccacaccgaggccatccagcacagcagcgtgagcaccagcaacggcgtgagcagcaccagcaaggccgaggccgtggccaccagcgtgctgacccagatggccgaccagagcaccgagcccgccctgagccagatcgtgatggcccccagcagccagagccagcccagcggcagctag

SEQ ID NO: 9252 - DNA, 1518 bp, Artificial Sequence; identical to SEQ ID NO: 9249
  Description of Artificial Sequence: Synthetic coding sequence

SEQ ID NO: 9253 - DNA, 1344 bp, Artificial Sequence; identical to SEQ ID NO: 9250
  Description of Artificial Sequence: Synthetic coding sequence

SEQ ID NO: 9254 - DNA, 630 bp, Artificial Sequence
  Description of Artificial Sequence: Synthetic coding sequence
atgaagttcaagctgcacgtgaacagcgccagacagtacaaggacctgtggaacatgagcgacgacaagcccttcctgtgcaccgcccccggctgcggccagagattcaccaacgaggaccacctggccgtgcacaagcacaagcacgagatgaccctgaagttcggccccgccagaaacgacagcgtgatcgtggccgaccagacccccacccccaccagattcctgaagaactgcgaggaggtgggcctgttcaacgagctggccagccccttcgagaacgagttcaagaaggccagcgaggacgacatcaagaagatgcccctggacctgagccccctggccacccccatcatcagaagcaagatcgaggagcccagcgtggtggagaccacccaccaggacagccccctgccccaccccgagagcaccaccagcgacgagaaggaggtgcccctggcccagaccgcccagcccaccagcgccatcgtgagacccgccagcctgcaggtgcccaacgtgctgctgaccagcagcgacagcagcgtgatcatccagcaggccgtgcccagccccaccagcagcaccgtgatcacccaggcccccagcagcaacagacccatcgtgtag

SEQ ID NO: 9255 - DNA, 1188 bp, Artificial Sequence
  Description of Artificial Sequence: Synthetic coding sequence
atgaagttcaagctgcacgtgaacagcgccagacagtacaaggacctgtggaacatgagcgacgacaagcccttcctgtgcaccgcccccggctgcggccagagattcaccaacgaggaccacctggccgtgcacaagcacaagcacgagatgaccctgaagttcggccccgccagaaacgacagcgtgatcgtggccgaccagacccccacccccaccagattcctgaagaactgcgaggaggtgggcctgttcaacgagctggccagccccttcgagaacgagttcaagaaggccagcgaggacgacatcaagaagatgcccctggacctgagccccctggccacccccatcatcagaagcaagatcgaggagcccagcgtggtggagaccacccaccaggacagccccctgccccaccccgagagcaccaccagcgacgagaaggaggtgcccctggcccagaccgcccagcccaccagcgccatcgtgagacccgccagcctgcaggtgcccaacgtgctgctgaccagcagcgacagcagcgtgatcatccagcaggccgtgcccagccccaccagcagcaccgtgatcacccaggcccccagcagcaacagacccatcgtgcccgtgcccggccccttccccctgctgctgcacctgcccaacggccagaccatgcccgtggccatccccgccagcatcaccagcagcaacgtgcacgtgcccgccgccgtgcccctggtgagacccgtgaccatggtgcccagcgtgcccggcatccccggccccagcagcccccagcccgtgcagagcgaggccaagatgagactgaaggccgccctgacccagcagcacccccccgtgaccaacggcgacaccgtgaagggccacggcagcggcctggtgagaacccagagcgaggagagcagaccccagagcctgcagcagcccgccaccagcaccaccgagacccccgccagccccgcccacaccaccccccagacccagagcaccagcggcagaagaagaagagccgccaacgaggaccccgacgagaagagaagaaagttcctggagagaaacagagccgccgccagcagatgcagacagaagagaaaggtgtgggtgcagagcctggagaagaaggccgaggacctgagcagcctgaacggccagctgcagtag

SEQ ID NO: 9256 - DNA, 714 bp, Artificial Sequence
  Description of Artificial Sequence: Synthetic coding sequence
atgaagttcaagctgcacgtgaacagcgccagacagtacaaggacctgtggaacatgagcgacgacaagcccttcctgtgcaccgcccccggctgcggccagagattcaccaacgaggaccacctggccgtgcacaagcacaagcacgagatgaccctgaagttcggccccgccagaaacgacagcgtgatcgtggccgaccagacccccacccccaccagattcctgaagaactgcgaggaggtgggcctgttcaacgagctggccagccccttcgagaacgagttcaagaaggccagcgaggacgacatcaagaagatgcccctggacctgagccccctggccacccccatcatcagaagcaagatcgaggagcccagcgtggtggagaccacccaccaggacagccccctgccccaccccgagagcaccaccagcgacgagaaggaggtgcccctggcccagaccgcccagcccaccagcgccatcgtgagacccgccagcctgcaggtgcccaacgtgctgctgaccagcagcgacagcagcgtgatcatccagcaggccgtgcccagccccaccagcagcaccgtgatcacccaggcccccagcagcaacagacccatcgtgagcttcgaccagagcccctggtgcctggtgttccaggagagccaggtgctgcccctgcccaaccagtacagccagaagcagaagtag

SEQ ID NO: 9257 - DNA, 1464 bp, Artificial Sequence
  Description of Artificial Sequence: Synthetic coding sequence
atgagcgacgacaagcccttcctgtgcaccgcccccggctgcggccagagattcaccaacgaggaccacctggccgtgcacaagcacaagcacgagatgaccctgaagttcggccccgccagaaacgacagcgtgatcgtggccgaccagacccccacccccaccagattcctgaagaactgcgaggaggtgggcctgttcaacgagctggccagccccttcgagaacgagttcaagaaggccagcgaggacgacatcaagaagatgcccctggacctgagccccctggccacccccatcatcagaagcaagatcgaggagcccagcgtggtggagaccacccaccaggacagccccctgccccaccccgagagcaccaccagcgacgagaaggaggtgcccctggcccagaccgcccagcccaccagcgccatcgtgagacccgccagcctgcaggtgcccaacgtgctgctgaccagcagcgacagcagcgtgatcatccagcaggccgtgcccagccccaccagcagcaccgtgatcacccaggcccccagcagcaacagacccatcgtgcccgtgcccggccccttccccctgctgctgcacctgcccaacggccagaccatgcccgtggccatccccgccagcatcaccagcagcaacgtgcacgtgcccgccgccgtgcccctggtgagacccgtgaccatggtgcccagcgtgcccggcatccccggccccagcagcccccagcccgtgcagagcgaggccaagatgagactgaaggccgccctgacccagcagcacccccccgtgaccaacggcgacaccgtgaagggccacggcagcggcctggtgagaacccagagcgaggagagcagaccccagagcctgcagcagcccgccaccagcaccaccgagacccccgccagccccgcccacaccaccccccagacccagagcaccagcggcagaagaagaagagccgccaacgaggaccccgacgagaagagaagaaagttcctggagagaaacagagccgccgccagcagatgcagacagaagagaaaggtgtgggtgcagagcctggagaagaaggccgaggacctgagcagcctgaacggccagctgcagagcgaggtgaccctgctgagaaacgaggtggcccagctgaagcagctgctgctggcccacaaggactgccccgtgaccgccatgcagaagaagagcggctaccacaccgccgacaaggacgacagcagcgaggacatcagcgtgcccagcagcccccacaccgaggccatccagcacagcagcgtgagcaccagcaacggcgtgagcagcaccagcaaggccgaggccgtggccaccagcgtgctgacccagatggccgaccagagcaccgagcccgccctgagccagatcgtgatggcccccagcagccagagccagcccagcggcagctag

SEQ ID NO: 9258 - DNA, 1188 bp, Artificial Sequence; identical to SEQ ID NO: 9255
  Description of Artificial Sequence: Synthetic coding sequence

SEQ ID NO: 9259 - DNA, 1188 bp, Artificial Sequence; identical to SEQ ID NO: 9255
  Description of Artificial Sequence: Synthetic coding sequence

SEQ ID NO: 9260 - DNA, 660 bp, Artificial Sequence
  Description of Artificial Sequence: Synthetic coding sequence
atgagcgacgacaagcccttcctgtgcaccgcccccggctgcggccagagattcaccaacgaggaccacctggccgtgcacaagcacaagcacgagatgaccctgaagttcggccccgccagaaacgacagcgtgatcgtggccgaccagacccccacccccaccagattcctgaagaactgcgaggaggtgggcctgttcaacgagctggccagccccttcgagaacgagttcaagaaggccagcgaggacgacatcaagaagatgcccctggacctgagccccctggccacccccatcatcagaagcaagatcgaggagcccagcgtggtggagaccacccaccaggacagccccctgccccaccccgagagcaccaccagcgacgagaaggaggtgcccctggcccagaccgcccagcccaccagcgccatcgtgagacccgccagcctgcaggtgcccaacgtgctgctgaccagcagcgacagcagcgtgatcatccagcaggccgtgcccagccccaccagcagcaccgtgatcacccaggcccccagcagcaacagacccatcgtgagcttcgaccagagcccctggtgcctggtgttccaggagagccaggtgctgcccctgcccaaccagtacagccagaagcagaagtag

SEQ ID NO: 9261 - DNA, 1134 bp, Artificial Sequence
  Description of Artificial Sequence: Synthetic coding sequence
atgagcgacgacaagcccttcctgtgcaccgcccccggctgcggccagagattcaccaacgaggaccacctggccgtgcacaagcacaagcacgagatgaccctgaagttcggccccgccagaaacgacagcgtgatcgtggccgaccagacccccacccccaccagattcctgaagaactgcgaggaggtgggcctgttcaacgagctggccagccccttcgagaacgagttcaagaaggccagcgaggacgacatcaagaagatgcccctggacctgagccccctggccacccccatcatcagaagcaagatcgaggagcccagcgtggtggagaccacccaccaggacagccccctgccccaccccgagagcaccaccagcgacgagaaggaggtgcccctggcccagaccgcccagcccaccagcgccatcgtgagacccgccagcctgcaggtgcccaacgtgctgctgaccagcagcgacagcagcgtgatcatccagcaggccgtgcccagccccaccagcagcaccgtgatcacccaggcccccagcagcaacagacccatcgtgcccgtgcccggccccttccccctgctgctgcacctgcccaacggccagaccatgcccgtggccatccccgccagcatcaccagcagcaacgtgcacgtgcccgccgccgtgcccctggtgagacccgtgaccatggtgcccagcgtgcccggcatccccggccccagcagcccccagcccgtgcagagcgaggccaagatgagactgaaggccgccctgacccagcagcacccccccgtgaccaacggcgacaccgtgaagggccacggcagcggcctggtgagaacccagagcgaggagagcagaccccagagcctgcagcagcccgccaccagcaccaccgagacccccgccagccccgcccacaccaccccccagacccagagcaccagcggcagaagaagaagagccgccaacgaggaccccgacgagaagagaagaaagttcctggagagaaacagagccgccgccagcagatgcagacagaagagaaaggtgtgggtgcagagcctggagaagaaggccgaggacctgagcagcctgaacggccagctgcagtag

SEQ ID NO: 9262 - DNA, 1449 bp, Artificial Sequence
  Description of Artificial Sequence: Synthetic coding sequence
atgaagttcaagctgcacgtgaacagcgccagacagtacaaggacctgtggaacatgagcgacgacaagcccttcctgtgcaccgcccccggctgcggccagagattcaccaacgaggaccacctggccgaccagacccccacccccaccagattcctgaagaactgcgaggaggtgggcctgttcaacgagctggccagccccttcgagaacgagttcaagaaggccagcgaggacgacatcaagaagatgcccctggacctgagccccctggccacccccatcatcagaagcaagatcgaggagcccagcgtggtggagaccacccaccaggacagccccctgccccaccccgagagcaccaccagcgacgagaaggaggtgcccctggcccagaccgcccagcccaccagcgccatcgtgagacccgccagcctgcaggtgcccaacgtgctgctgaccagcagcgacagcagcgtgatcatccagcaggccgtgcccagccccaccagcagcaccgtgatcacccaggcccccagcagcaacagacccatcgtgcccgtgcccggccccttccccctgctgctgcacctgcccaacggccagaccatgcccgtggccatccccgccagcatcaccagcagcaacgtgcacgtgcccgccgccgtgcccctggtgagacccgtgaccatggtgcccagcgtgcccggcatccccggccccagcagcccccagcccgtgcagagcgaggccaagatgagactgaaggccgccctgacccagcagcacccccccgtgaccaacggcgacaccgtgaagggccacggcagcggcctggtgagaacccagagcgaggagagcagaccccagagcctgcagcagcccgccaccagcaccaccgagacccccgccagccccgcccacaccaccccccagacccagagcaccagcggcagaagaagaagagccgccaacgaggaccccgacgagaagagaagaaagttcctggagagaaacagagccgccgccagcagatgcagacagaagagaaaggtgtgggtgcagagcctggagaagaaggccgaggacctgagcagcctgaacggccagctgcagagcgaggtgaccctgctgagaaacgaggtggcccagctgaagcagctgctgctggcccacaaggactgccccgtgaccgccatgcagaagaagagcggctaccacaccgccgacaaggacgacagcagcgaggacatcagcgtgcccagcagcccccacaccgaggccatccagcacagcagcgtgagcaccagcaacggcgtgagcagcaccagcaaggccgaggccgtggccaccagcgtgctgacccagatggccgaccagagcaccgagcccgccctgagccagatcgtgatggcccccagcagccagagccagcccagcggcagctag

SEQ ID NO: 9263 - DNA, 2136 bp, Artificial Sequence
  Description of Artificial Sequence: Synthetic coding sequence
atgaagctgaagctgaacgtgctgaccatcatcctgctgcccgtgcacctgctgatcaccatctacagcgccctgatcttcatcccctggtacttcctgaccaacgccaagaagaagaacgccatggccaagagaatcaaggccaagcccaccagcgacaagcccggcagcccctacagaagcgtgacccacttcgacagcctggccgtgatcgacatccccggcgccgacaccctggacaagctgttcgaccacgccgtgagcaagttcggcaagaaggacagcctgggcaccagagagatcctgagcgaggagaacgagatgcagcccaacggcaaggtgttcaagaagctgatcctgggcaactacaagtggatgaactacctggaggtgaacagaagagtgaacaacttcggcagcggcctgaccgccctgggcctgaagcccaagaacaccatcgccatcttctgcgagaccagagccgagtggatgatcgccgcccagacctgcttcaagtacaacttccccctggtgaccctgtacgccaccctgggcaaggaggccgtggtgcacggcctgaacgagagcgaggccagctacctgatcaccagcgtggagctgctggagagcaagctgaagaccgccctgctggacatcagctgcgtgaagcacatcatctacgtggacaacaaggccatcaacaaggccgagtaccccgagggcttcgagatccacagcatgcagagcgtggaggagctgggcagcaaccccgagaacctgggcatcccccccagcagacccacccccagcgacatggccatcgtgatgtacaccagcggcagcaccggcagacccaagggcgtgatgatgcaccacagcaacctgatcgccggcatgaccggccagtgcgagagaatccccggcctgggccccaaggacacctacatcggctacctgcccctggcccacgtgctggagctgaccgccgagatcagctgcttcacctacggctgcagaatcggctacagcagccccctgaccctgagcgaccagagcagcaagatcaagaagggcagcaagggcgactgcaccgtgctgaagcccaccctgatggccgccgtgcccgagatcatggacagaatctacaagaacgtgatgagcaaggtgcaggagatgaactacatccagaagaccctgttcaagatcggctacgactacaagctggagcagatcaagaagggctacgacgcccccctgtgcaacctgctgctgttcaagaaggtgaaggccctgctgggcggcaacgtgagaatgatgctgagcggcggcgcccccctgagcccccagacccacagattcatgaacgtgtgcttctgctgccccatcggccagggctacggcctgaccgagagctgcggcgccggcaccgtgaccgaggtgaccgactacaccaccggcagagtgggcgcccccctgatctgctgcgagatcaagctgaaggactggcaggagggcggctacaccatcaacgacaagcccaaccccagaggcgagatcgtgatcggcggccagaacatcagcatgggctacttcaagaacgaggagaagaccgccgaggactacagcgtggacgagaacggccagagatggttctgcaccggcgacatcggcgagttccaccccgacggctgcctgcagatcatcgacagaaagaaggacctggtgaagctgcaggccggcgagtacgtgagcctgggcaaggtggaggccgccctgaagaactgccccctgatcgacaacatctgcgccttcgccaagagcgaccagagctacgtgatcagcttcgtggtgcccaaccagaagagactgaccctgctggcccagcagaagggcgtggagggcacctgggtggacatctgcaacaaccccgccatggaggccgagatcctgaaggagatcagagaggccgccaacgccatgaagctggagagattcgagatccccatcaaggtgagactgagccccgagccctggacccccgagaccggcctggtgaccgacgccttcaagctgaagagaaaggagctgagaaaccactacctgaaggacatcgagagaatgtacggcggcaagtag

SEQ ID NO: 9264 - DNA, 2013 bp, Artificial Sequence
  Description of Artificial Sequence: Synthetic coding sequence
atggccaagagaatcaaggccaagcccaccagcgacaagcccggcagcccctacagaagcgtgacccacttcgacagcctggccgtgatcgacatccccggcgccgacaccctggacaagctgttcgaccacgccgtgagcaagttcggcaagaaggacagcctgggcaccagagagatcctgagcgaggagaacgagatgcagcccaacggcaaggtgttcaagaagctgatcctgggcaactacaagtggatgaactacctggaggtgaacagaagagtgaacaacttcggcagcggcctgaccgccctgggcctgaagcccaagaacaccatcgccatcttctgcgagaccagagccgagtggatgatcgccgcccagacctgcttcaagtacaacttccccctggtgaccctgtacgccaccctgggcaaggaggccgtggtgcacggcctgaacgagagcgaggccagctacctgatcaccagcgtggagctgctggagagcaagctgaagaccgccctgctggacatcagctgcgtgaagcacatcatctacgtggacaacaaggccatcaacaaggccgagtaccccgagggcttcgagatccacagcatgcagagcgtggaggagctgggcagcaaccccgagaacctgggcatcccccccagcagacccacccccagcgacatggccatcgtgatgtacaccagcggcagcaccggcagacccaagggcgtgatgatgcaccacagcaacctgatcgccggcatgaccggccagtgcgagagaatccccggcctgggccccaaggacacctacatcggctacctgcccctggcccacgtgctggagctgaccgccgagatcagctgcttcacctacggctgcagaatcggctacagcagccccctgaccctgagcgaccagagcagcaagatcaagaagggcagcaagggcgactgcaccgtgctgaagcccaccctgatggccgccgtgcccgagatcatggacagaatctacaagaacgtgatgagcaaggtgcaggagatgaactacatccagaagaccctgttcaagatcggctacgactacaagctggagcagatcaagaagggctacgacgcccccctgtgcaacctgctgctgttcaagaaggtgaaggccctgctgggcggcaacgtgagaatgatgctgagcggcggcgcccccctgagcccccagacccacagattcatgaacgtgtgcttctgctgccccatcggccagggctacggcctgaccgagagctgcggcgccggcaccgtgaccgaggtgaccgactacaccaccggcagagtgggcgcccccctgatctgctgcgagatcaagctgaaggactggcaggagggcggctacaccatcaacgacaagcccaaccccagaggcgagatcgtgatcggcggccagaacatcagcatgggctacttcaagaacgaggagaagaccgccgaggactacagcgtggacgagaacggccagagatggttctgcaccggcgacatcggcgagttccaccccgacggctgcctgcagatcatcgacagaaagaaggacctggtgaagctgcaggccggcgagtacgtgagcctgggcaaggtggaggccgccctgaagaactgccccctgatcgacaacatctgcgccttcgccaagagcgaccagagctacgtgatcagcttcgtggtgcccaaccagaagagactgaccctgctggcccagcagaagggcgtggagggcacctgggtggacatctgcaacaaccccgccatggaggccgagatcctgaaggagatcagagaggccgccaacgccatgaagctggagagattcgagatccccatcaaggtgagactgagccccgagccctggacccccgagaccggcctggtgaccgacgccttcaagctgaagagaaaggagctgagaaaccactacctgaaggacatcgagagaatgtacggcggcaagtag

SEQ ID NO: 9265 - DNA, 2136 bp, Artificial Sequence; identical to SEQ ID NO: 9263
  Description of Artificial Sequence: Synthetic coding sequence

SEQ ID NO: 9266 - DNA, 165 bp, Artificial Sequence
  Description of Artificial Sequence: Synthetic coding sequence
atgaagctgaagctgaacgtgctgaccatcatcctgctgcccgtgcacctgctgatcaccatctacagcgccctgatcttcatcccctggtacttcctgaccaacgccaagaagaagaacgccatggccaagagaatcaaggccaagcccaccagcgacaagtag

SEQ ID NO: 9267 - DNA, 438 bp, Artificial Sequence
  Description of Artificial Sequence: Synthetic coding sequence
atgaagctgaagctgaacgtgctgaccatcatcctgctgcccgtgcacctgctgatcaccatctacagcgccctgatcttcatcccctggtacttcctgaccaacgccaagaagaagaacgccatggccaagagaatcaaggccaagcccaccagcgacaagcccggcagcccctacagaagcgtgacccacttcgacagcctggccgtgatcgacatccccggcgccgacaccctggacaagctgttcgaccacgccgtgagcaagttcggcaagaaggacagcctgggcaccagagagatcctgagcgaggagaacgagatgcagcccaacggcaaggtgttcaagaagctgatcctgggcaactacaagtggatgaactacctggaggtgaacagaagagtgaacaacttcggcagcggcctgaccgccctgtag

SEQ ID NO: 9268 - DNA, 381 bp, Artificial Sequence
  Description of Artificial Sequence: Synthetic coding sequence
atgaagctgaagctgaacgtgctgaccatcatcctgctgcccgtgcacctgctgatcaccatctacagcgccctgatcttcatcccctggtacttcctgaccaacgccaagaagaagaacgccatggccaagagaatcaaggccaagcccaccagcgacaagcccggcagcccctacagaagcgtgacccacttcgacagcctggccgtgatcgacatccccggcgccgacaccctggacaagctgttcgaccacgccgtgagcaagttcggcaagaaggacagcctgggcaccagagagatcctgagcgaggagaacgagatgcagcccaacggcaaggtgttcaagaagctgatcctgggcaactacaagtggatgtag

SEQ ID NO: 9269 - DNA, 465 bp, Artificial Sequence
  Description of Artificial Sequence: Synthetic coding sequence
atggccaagagaatcaaggccaagcccaccagcgacaagcccggcagcccctacagaagcgtgacccacttcgacagcctggccgtgatcgacatccccggcgccgacaccctggacaagctgttcgaccacgccgtgagcaagttcggcaagaaggacagcctgggcaccagagagatcctgagcgaggagaacgagatgcagcccaacggcaaggtgttcaagaagctgatcctgggcaactacaagtggatgaactacctggaggtgaacagaagagtgaacaacttcggcagcggcctgaccgccctgggcctgaagcccaagaacaccatcgccatcttctgcgagaccagagccgagtggatgatcgccgcccagacctgcttcaagtacaacttccccctggtgaccctgtacgccaccctgggcaaggaggccgtggtgcacggcctgaacgagtag

SEQ ID NO: 9270 - DNA, 387 bp, Artificial Sequence
  Description of Artificial Sequence: Synthetic coding sequence
atgaagctgaagctgaacgtgctgaccatcatcctgctgcccgtgcacctgctgatcaccatctacagcgccctgatcttcatcccctggtacttcctgaccaacgccaagaagaagaacgccatggccaagagaatcaaggccaagcccaccagcgacaagcccggcagcccctacagaagcgtgacccacttcgacagcctggccgtgatcgacatccccggcgccgacaccctggacaagctgttcgaccacgccgtgagcaagttcggcaagaaggacagcctgggcaccagagagatcctgagcgaggagaacgagatgcagcccaacggcaaggtgttcaagaagctgatcctgggcaactacaagtggatgaactactag

SEQ ID NO: 9271 - DNA, 2475 bp, Artificial Sequence
  Description of Artificial Sequence: Synthetic coding sequence
atgagacagagcctgctgttcctgaccagcgtggtgcccttcgtgctggcccccagaccccccgacgaccccggcttcggcccccaccagagactggagaagctggacagcctgctgagcgactacgacatcctgagcctgagcaacatccagcagcacagcgtgagaaagagagacctgcagaccagcacccacgtggagaccctgctgaccttcagcgccctgaagagacacttcaagctgtacctgaccagcagcaccgagagattcagccagaacttcaaggtggtggtggtggacggcaagaacgagagcgagtacaccgtgaagtggcaggacttcttcaccggccacgtggtgggcgagcccgacagcagagtgctggcccacatcagagacgacgacgtgatcatcagaatcaacaccgacggcgccgagtacaacatcgagcccctgtggagattcgtgaacgacaccaaggacaagagaatgctggtgtacaagagcgaggacatcaagaacgtgagcagactgcagagccccaaggtgtgcggctacctgaaggtggacaacgaggagctgctgcccaagggcctggtggacagagagccccccgaggagctggtgcacagagtgaagagaagagccgaccccgaccccatgaagaacacctgcaagctgctggtggtggccgaccacagattctacagatacatgggcagaggcgaggagagcaccaccaccaactacctgatcgagctgatcgacagagtggacgacatctacagaaacaccagctgggacaacgccggcttcaagggctacggcatccagatcgagcagatcagaatcctgaagagcccccaggaggtgaagcccggcgagaagcactacaacatggccaagagctaccccaacgaggagaaggacgcctgggacgtgaagatgctgctggagcagttcagcttcgacatcgccgaggaggccagcaaggtgtgcctggcccacctgttcacctaccaggacttcgacatgggcaccctgggcctggcctacgtgggcagccccagagccaacagccacggcggcgtgtgccccaaggcctactacagccccgtgggcaagaagaacatctacctgaacagcggcctgaccagcaccaagaactacggcaagaccatcctgaccaaggaggccgacctggtgaccacccacgagctgggccacaacttcggcgccgagcacgaccccgacggcctggccgagtgcgcccccaacgaggaccagggcggcaagtacgtgatgtaccccatcgccgtgagcggcgaccacgagaacaacaagatgttcagcaactgcagcaagcagagcatctacaagaccatcgagagcaaggcccaggagtgcttccaggagagaagcaacaaggtgtgcggcaacagcagagtggacgagggcgaggagtgcgaccccggcatcatgtacctgaacaacgacacctgctgcaacagcgactgcaccctgaaggagggcgtgcagtgcagcgacagaaacagcccctgctgcaagaactgccagttcgagaccgcccagaagaagtgccaggaggccatcaacgccacctgcaagggcgtgagctactgcaccggcaacagcagcgagtgccccccccccggcaacgccgaggacgacaccgtgtgcctggacctgggcaagtgcaaggacggcaagtgcatccccttctgcgagagagagcagcagctggagagctgcgcctgcaacgagaccgacaacagctgcaaggtgtgctgcagagacctgagcggcagatgcgtgccctacgtggacgccgagcagaagaacctgttcctgagaaagggcaagccctgcaccgtgggcttctgcgacatgaacggcaagtgcgagaagagagtgcaggacgtgatcgagagattctgggacttcatcgaccagctgagcatcaacaccttcggcaagttcctggccgacaacatcgtgggcagcgtgctggtgttcagcctgatcttctggatccccttcagcatcctggtgcactgcgtggacaagaagctggacaagcagtacgagagcctgagcctgttccaccccagcaacgtggagatgctgagcagcatggacagcgccagcgtgagaatcatcaagcccttccccgccccccagacccccggcagactgcagcccgcccccgtgatccccagcgcccccgccgcccccaagctggaccaccagagaatggacaccatccaggaggaccccagcaccgacagccacatggacgaggacggcttcgagaaggaccccttccccaacagcagcaccgccgccaagagcttcgaggacctgaccgaccaccccgtgaccagaagcgagaaggccgccagcttcaagctgcagagacagaacagagtggacagcaaggagaccgagtgctag

SEQ ID NO: 9272 - DNA, 777 bp, Artificial Sequence
  Description of Artificial Sequence: Synthetic coding sequence
atgagacagagcctgctgttcctgaccagcgtggtgcccttcgtgctggcccccagaccccccgacgaccccggcttcggcccccaccagagactggagaagctggacagcctgctgagcgactacgacatcctgagcctgagcaacatccagcagcacagcgtgagaaagagagacctgcagaccagcacccacgtggagaccctgctgaccttcagcgccctgaagagacacttcaagctgtacctgaccagcagcaccgagagattcagccagaacttcaaggtggtggtggtggacggcaagaacgagagcgagtacaccgtgaagtggcaggacttcttcaccggccacgtggtgggcgagcccgacagcagagtgctggcccacatcagagacgacgacgtgatcatcagaatcaacaccgacggcgccgagtacaacatcgagcccctgtggagattcgtgaacgacaccaaggacaagagaatgctggtgtacaagagcgaggacatcaagaacgtgagcagactgcagagccccaaggtgtgcggctacctgaaggtggacaacgaggagctgctgcccaagggcctggtggacagagagccccccgaggagctggtgcacagagtgaagagaagagccgaccccgaccccatgaagaacacctgcaagctgctggtggtggccgaccacagattctacagatacatgggcagaggcgaggagagcaccaccaccaactacctgatccacaccgacagagccaactag

SEQ ID NO: 9273 - DNA, 2499 bp, Artificial Sequence
  Description of Artificial Sequence: Synthetic coding sequence
atgaagccccccggcagcagcagcagacagccccccctggccggctgcagcctggccggcgccagctgcggcccccagagaggccccgccggcagcgtgcccgccagcgcccccgccagaacccccccctgcagactgctgctggtgctgctgctgctgccccccctggccgccagcagcagacccagagcctggggcgccgccgcccccagcgccccccactggaacgagaccgccgagaagaacctgggcgtgctggccgacgaggacaacaccctgcagcagaacagcagcagcaacatcagctacagcaacgccatgcagaaggagatcaccctgcccagcagactgatctactacatcaaccaggacagcgagagcccctaccacgtgctggacaccaaggccagacaccagcagaagcacaacaaggccgtgcacctggcccaggccagcttccagatcgaggccttcggcagcaagttcatcctggacctgatcctgaacaacggcctgctgagcagcgactacgtggagatccactacgagaacggcaagccccagtacagcaagggcggcgagcactgctactaccacggcagcatcagaggcgtgaaggacagcaaggtggccctgagcacctgcaacggcctgcacggcatgttcgaggacgacaccttcgtgtacatgatcgagcccctggagctggtgcacgacgagaagagcaccggcagaccccacatcatccagaagaccctggccggccagtacagcaagcagatgaagaacctgaccatggagagaggcgaccagtggcccttcctgagcgagctgcagtggctgaagagaagaaagagagccgtgaaccccagcagaggcatcttcgaggagatgaagtacctggagctgatgatcgtgaacgaccacaagacctacaagaagcacagaagcagccacgcccacaccaacaacttcgccaagagcgtggtgaacctggtggacagcatctacaaggagcagctgaacaccagagtggtgctggtggccgtggagacctggaccgagaaggaccagatcgacatcaccaccaaccccgtgcagatgctgcacgagttcagcaagtacagacagagaatcaagcagcacgccgacgccgtgcacctgatcagcagagtgaccttccactacaagagaagcagcctgagctacttcggcggcgtgtgcagcagaaccagaggcgtgggcgtgaacgagtacggcctgcccatggccgtggcccaggtgctgagccagagcctggcccagaacctgggcatccagtgggagcccagcagcagaaagcccaagtgcgactgcaccgagagctggggcggctgcatcatggaggagaccggcgtgagccacagcagaaagttcagcaagtgcagcatcctggagtacagagacttcctgcagagaggcggcggcgcctgcctgttcaacagacccaccaagctgttcgagcccaccgagtgcggcaacggctacgtggaggccggcgaggagtgcgactgcggcttccacgtggagtgctacggcctgtgctgcaagaagtgcagcctgagcaacggcgcccactgcagcgacggcccctgctgcaacaacaccagctgcctgttccagcccagaggctacgagtgcagagacgccgtgaacgagtgcgacatcaccgagtactgcaccggcgacagcggccagtgcccccccaacctgcacaagcaggacggctacgcctgcaaccagaaccagggcagatgctacaacggcgagtgcaagaccagagacaaccagtgccagtacatctggggcaccaaggccgccggcagcgacaagttctgctacgagaagctgaacaccgagggcaccgagaagggcaactgcggcaaggacggcgacagatggatccagtgcagcaagcacgacgtgttctgcggcttcctgctgtgcaccaacctgaccagagcccccagaatcggccagctgcagggcgagatcatccccaccagcttctaccaccagggcagagtgatcgactgcagcggcgcccacgtggtgctggacgacgacaccgacgtgggctacgtggaggacggcaccccctgcggccccagcatgatgtgcctggacagaaagtgcctgcagatccaggccctgaacatgagcagctgccccctggacagcaagggcaaggtgtgcagcggccacggcgtgtgcagcaacgaggccacctgcatctgcgacttcacctgggccggcaccgactgcagcatcagagaccccgtgagaaacctgcacccccccaaggacgagggccccaagggccccagcgccaccaacctgatcatcggcagcatcgccggcgccatcctggtggccgccatcgtgctgggcggcaccggctggggcttcaagaacgtgaagaagagaagattcgaccccacccagcagggccccatctag

SEQ ID NO: 9274 - DNA, 2499 bp, Artificial Sequence
  Description of Artificial Sequence: Synthetic coding sequence
atgaagccccccggcagcagcagcagacagccccccctggccggctgcagcctggccggcgccagctgcggcccccagagaggccccgccggcagcgtgcccgccagcgcccccgccagaacccccccctgcagactgctgctggtgctgctgctgctgccccccctggccgccagcagcagacccagagcctggggcgccgccgcccccagcgccccccactggaacgagaccgccgagaagaacctgggcgtgctggccgacgaggacaacaccctgcagcagaacagcagcagcaacatcagctacagcaacgccatgcagaaggagatcaccctgcccagcagactgatctactacatcaaccaggacagcgagagcccctaccacgtgctggacaccaaggccagacaccagcagaagcacaacaaggccgtgcacctggcccaggccagcttccagatcgaggccttcggcagcaagttcatcctggacctgatcctgaacaacggcctgctgagcagcgactacgtggagatccactacgagaacggcaagccccagtacagcaagggcggcgagcactgctactaccacggcagcatcagaggcgtgaaggacagcaaggtggccctgagcacctgcaacggcctgcacggcatgttcgaggacgacaccttcgtgtacatgatcgagcccctggagctggtgcacgacgagaagagcaccggcagaccccacatcatccagaagaccctggccggccagtacagcaagcagatgaagaacctgaccatggagagaggcgaccagtggcccttcctgagcgagctgcagtggctgaagagaagaaagagagccgtgaaccccagcagaggcatcttcgaggagatgaagtacctggagctgatgatcgtgaacgaccacaagacctacaagaagcacagaagcagccacgcccacaccaacaacttcgccaagagcgtggtgaacctggtggacagcatctacaaggagcagctgaacaccagagtggtgctggtggccgtggagacctggaccgagaaggaccagatcgacatcaccaccaaccccgtgcagatgctgcacgagttcagcaagtacagacagagaatcaagcagcacgccgacgccgtgcacctgatcagcagagtgaccttccactacaagagaagcagcctgagctacttcggcggcgtgtgcagcagaaccagaggcgtgggcgtgaacgagtacggcctgcccatggccgtggcccaggtgctgagccagagcctggcccagaacctgggcatccagtgggagcccagcagcagaaagcccaagtgcgactgcaccgagagctggggcggctgcatcatggaggagaccggcgtgagccacagcagaaagttcagcaagtgcagcatcctggagtacagagacttcctgcagagaggcggcggcgcctgcctgttcaacagacccaccaagctgttcgagcccaccgagtgcggcaacggctacgtggaggccggcgaggagtgcgactgcggcttccacgtggagtgctacggcctgtgctgcaagaagtgcagcctgagcaacggcgcccactgcagcgacggcccctgctgcaacaacaccagctgcctgttccagcccagaggctacgagtgcagagacgccgtgaacgagtgcgacatcaccgagtactgcaccggcgacagcggccagtgcccccccaacctgcacaagcaggacggctacgcctgcaaccagaaccagggcagatgctacaacggcgagtgcaagaccagagacaaccagtgccagtacatctggggcaccaaggccgccggcagcgacaagttctgctacgagaagctgaacaccgagggcaccgagaagggcaactgcggcaaggacggcgacagatggatccagtgcagcaagcacgacgtgttctgcggcttcctgctgtgcaccaacctgaccagagcccccagaatcggccagctgcagggcgagatcatccccaccagcttctaccaccagggcagagtgatcgactgcagcggcgcccacgtggtgctggacgacgacaccgacgtgggctacgtggaggacggcaccccctgcggccccagcatgatgtgcctggacagaaagtgcctgcagatccaggccctgaacatgagcagctgccccctggacagcaagggcaaggtgtgcagcggccacggcgtgtgcagcaacgaggccacctgcatctgcgacttcacctgggccggcaccgactgcagcatcagagaccccgtgagaaacctgcacccccccaaggacgagggccccaaggtgaacatggccaccagcagactgatcggcgccgtggccggcaccatcctggccctgggcgtgatcttcggcggcaccggctggggcatcgagaacgtgaagaagagaagattcgaccccacccagcagggccccatctag

SEQ ID NO: 9275 - DNA, 2499 bp, Artificial Sequence
  Description of Artificial Sequence: Synthetic coding sequence
atgaagccccccggcagcagcagcagacagccccccctggccggctgcagcctggccggcgccagctgcggcccccagagaggccccgccggcagcgtgcccgccagcgcccccgccagaacccccccctgcagactgctgctggtgctgctgctgctgccccccctggccgccagcagcagacccagagcctggggcgccgccgcccccagcgccccccactggaacgagaccgccgagaagaacctgggcgtgctggccgacgaggacaacaccctgcagcagaacagcagcagcaacatcagctacagcaacgccatgcagaaggagatcaccctgcccagcagactgatctactacatcaaccaggacagcgagagcccctaccacgtgctggacaccaaggccagacaccagcagaagcacaacaaggccgtgcacctggcccaggccagcttccagatcgaggccttcggcagcaagttcatcctggacctgatcctgaacaacggcctgctgagcagcgactacgtggagatccactacgagaacggcaagccccagtacagcaagggcggcgagcactgctactaccacggcagcatcagaggcgtgaaggacagcaaggtggccctgagcacctgcaacggcctgcacggcatgttcgaggacgacaccttcgtgtacatgatcgagcccctggagctggtgcacgacgagaagagcaccggcagaccccacatcatccagaagaccctggccggccagtacagcaagcagatgaagaacctgaccatggagagaggcgaccagtggcccttcctgagcgagctgcagtggctgaagagaagaaagagagccgtgaaccccagcagaggcatcttcgaggagatgaagtacctggagctgatgatcgtgaacgaccacaagacctacaagaagcacagaagcagccacgcccacaccaacaacttcgccaagagcgtggtgaacctggtggacagcatctacaaggagcagctgaacaccagagtggtgctggtggccgtggagacctggaccgagaaggaccagatcgacatcaccaccaaccccgtgcagatgctgcacgagttcagcaagtacagacagagaatcaagcagcacgccgacgccgtgcacctgatcagcagagtgaccttccactacaagagaagcagcctgagctacttcggcggcgtgtgcagcagaaccagaggcgtgggcgtgaacgagtacggcctgcccatggccgtggcccaggtgctgagccagagcctggcccagaacctgggcatccagtgggagcccagcagcagaaagcccaagtgcgactgcaccgagagctggggcggctgcatcatggaggagaccggcgtgagccacagcagaaagttcagcaagtgcagcatcctggagtacagagacttcctgcagagaggcggcggcgcctgcctgttcaacagacccaccaagctgttcgagcccaccgagtgcggcaacggctacgtggaggccggcgaggagtgcgactgcggcttccacgtggagtgctacggcctgtgctgcaagaagtgcagcctgagcaacggcgcccactgcagcgacggcccctgctgcaacaacaccagctgcctgttccagcccagaggctacgagtgcagagacgccgtgaacgagtgcgacatcaccgagtactgcaccggcgacagcggccagtgcccccccaacctgcacaagcaggacggctacgcctgcaaccagaaccagggcagatgctacaacggcgagtgcaagaccagagacaaccagtgccagtacatctggggcaccaaggccgccggcagcgacaagttctgctacgagaagctgaacaccgagggcaccgagaagggcaactgcggcaaggacggcgacagatggatccagtgcagcaagcacgacgtgttctgcggcttcctgctgtgcaccaacctgaccagagcccccagaatcggccagctgcagggcgagatcatccccaccagcttctaccaccagggcagagtgatcgactgcagcggcgcccacgtggtgctggacgacgacaccgacgtgggctacgtggaggacggcaccccctgcggccccagcatgatgtgcctggacagaaagtgcctgcagatccaggccctgaacatgagcagctgccccctggacagcaagggcaaggtgtgcagcggccacggcgtgtgcagcaacgaggccacctgcatctgcgacttcacctgggccggcaccgactgcagcatcagagaccccgtgagaaacctgcacccccccaaggacgagggccccaaggagatgagcagaagagagggcagcatcctgctgagcaaggcccccagcgagagcgccgccctggacggccacagactggccctgctggacagcggctacgacatcctggccgccgtgctgctggagctgctgagcctgtag

SEQ ID NO: 9276 - DNA, 2100 bp, Artificial Sequence
  Description of Artificial Sequence: Synthetic coding sequence
atgcagaaggagatcaccctgcccagcagactgatctactacatcaaccaggacagcgagagcccctaccacgtgctggacaccaaggccagacaccagcagaagcacaacaaggccgtgcacctggcccaggccagcttccagatcgaggccttcggcagcaagttcatcctggacctgatcctgaacaacggcctgctgagcagcgactacgtggagatccactacgagaacggcaagccccagtacagcaagggcggcgagcactgctactaccacggcagcatcagaggcgtgaaggacagcaaggtggccctgagcacctgcaacggcctgcacggcatgttcgaggacgacaccttcgtgtacatgatcgagcccctggagctggtgcacgacgagaagagcaccggcagaccccacatcatccagaagaccctggccggccagtacagcaagcagatgaagaacctgaccatggagagaggcgaccagtggcccttcctgagcgagctgcagtggctgaagagaagaaagagagccgtgaaccccagcagaggcatcttcgaggagatgaagtacctggagctgatgatcgtgaacgaccacaagacctacaagaagcacagaagcagccacgcccacaccaacaacttcgccaagagcgtggtgaacctggtggacagcatctacaaggagcagctgaacaccagagtggtgctggtggccgtggagacctggaccgagaaggaccagatcgacatcaccaccaaccccgtgcagatgctgcacgagttcagcaagtacagacagagaatcaagcagcacgccgacgccgtgcacctgatcagcagagtgaccttccactacaagagaagcagcctgagctacttcggcggcgtgtgcagcagaaccagaggcgtgggcgtgaacgagtacggcctgcccatggccgtggcccaggtgctgagccagagcctggcccagaacctgggcatccagtgggagcccagcagcagaaagcccaagtgcgactgcaccgagagctggggcggctgcatcatggaggagaccggcgtgagccacagcagaaagttcagcaagtgcagcatcctggagtacagagacttcctgcagagaggcggcggcgcctgcctgttcaacagacccaccaagctgttcgagcccaccgagtgcggcaacggctacgtggaggccggcgaggagtgcgactgcggcttccacgtggagtgctacggcctgtgctgcaagaagtgcagcctgagcaacggcgcccactgcagcgacggcccctgctgcaacaacaccagctgcctgttccagcccagaggctacgagtgcagagacgccgtgaacgagtgcgacatcaccgagtactgcaccggcgacagcggccagtgcccccccaacctgcacaagcaggacggctacgcctgcaaccagaaccagggcagatgctacaacggcgagtgcaagaccagagacaaccagtgccagtacatctggggcaccaaggccgccggcagcgacaagttctgctacgagaagctgaacaccgagggcaccgagaagggcaactgcggcaaggacggcgacagatggatccagtgcagcaagcacgacgtgttctgcggcttcctgctgtgcaccaacctgaccagagcccccagaatcggccagctgcagggcgagatcatccccaccagcttctaccaccagggcagagtgatcgactgcagcggcgcccacgtggtgctggacgacgacaccgacgtgggctacgtggaggacggcaccccctgcggccccagcatgatgtgcctggacagaaagtgcctgcagatccaggccctgaacatgagcagctgccccctggacagcaaggacgagggccccaaggcctgcttcctgaagagaaccaagtgcaagagctaccccaagcacagaaagtgccaggaggagaaggtgagaagctacagcgccagaccccacctgaaccagctgagatggatggacaccgccctgcactgctggatcctgggcatgacctacagccagcagtgctactggaactactag

SEQ ID NO: 9277 - DNA, 324 bp, Artificial Sequence
  Description of Artificial Sequence: Synthetic coding sequence
tgacagatccaggccctgaacatgagcagctgccccctggacagcaagggcaaggtgtgcagcggccacggcgtgtgcagcaacgaggccacctgcatctgcgacttcacctgggccggcaccgactgcagcatcagagaccccgtgagaaacctgcacccccccaaggacgagggccccaaggagatgagcagaagagagggcagcatcctgctgagcaaggcccccagcgagagcgccgccctggacggccacagactggccctgctggacagcggctacgacatcctggccgccgtgctgctggagctgctgagcctgtag

SEQ ID NO: 9278 - DNA, 8532 bp, Artificial Sequence
  Description of Artificial Sequence: Synthetic coding sequence
atggccgccgccagctacgaccagctgctgaagcaggtggaggccctgaagatggagaacagcaacctgagacaggagctggaggacaacagcaaccacctgaccaagctggagaccgaggccagcaacatgaaggaggtgctgaagcagctgcagggcagcatcgaggacgaggccatggccagcagcggccagatcgacctgctggagagactgaaggagctgaacctggacagcagcaacttccccggcgtgaagctgagaagcaagatgagcctgagaagctacggcagcagagagggcagcgtgagcagcagaagcggcgagtgcagccccgtgcccatgggcagcttccccagaagaggcttcgtgaacggcagcagagagagcaccggctacctggaggagctggagaaggagagaagcctgctgctggccgacctggacaaggaggagaaggagaaggactggtactacgcccagctgcagaacctgaccaagagaatcgacagcctgcccctgaccgagaacttcagcctgcagaccgacatgaccagaagacagctggagtacgaggccagacagatcagagtggccatggaggagcagctgggcacctgccaggacatggagaagagagcccagagaagaatcgccagaatccagcagatcgagaaggacatcctgagaatcagacagctgctgcagagccaggccaccgaggccgagagaagcagccagaacaagcacgagaccggcagccacgacgccgagagacagaacgagggccagggcgtgggcgagatcaacatggccaccagcggcaacggccagggcagcaccaccagaatggaccacgagaccgccagcgtgctgagcagcagcagcacccacagcgcccccagaagactgaccagccacctgggcaccaaggtggagatggtgtacagcctgctgagcatgctgggcacccacgacaaggacgacatgagcagaaccctgctggccatgagcagcagccaggacagctgcatcagcatgagacagagcggctgcctgcccctgctgatccagctgctgcacggcaacgacaaggacagcgtgctgctgggcaacagcagaggcagcaaggaggccagagccagagccagcgccgccctgcacaacatcatccacagccagcccgacgacaagagaggcagaagagagatcagagtgctgcacctgctggagcagatcagagcctactgcgagacctgctgggagtggcaggaggcccacgagcccggcatggaccaggacaagaaccccatgcccgcccccgtggagcaccagatctgccccgccgtgtgcgtgctgatgaagctgagcttcgacgaggagcacagacacgccatgaacgagctgggcggcctgcaggccatcgccgagctgctgcaggtggactgcgagatgtacggcctgaccaacgaccactacagcatcaccctgagaagatacgccggcatggccctgaccaacctgaccttcggcgacgtggccaacaaggccaccctgtgcagcatgaagggctgcatgagagccctggtggcccagctgaagagcgagagcgaggacctgcagcaggtgatcgccagcgtgctgagaaacctgagctggagagccgacgtgaacagcaagaagaccctgagagaggtgggcagcgtgaaggccctgatggagtgcgccctggaggtgaagaaggagagcaccctgaagagcgtgctgagcgccctgtggaacctgagcgcccactgcaccgagaacaaggccgacatctgcgccgtggacggcgccctggccttcctggtgggcaccctgacctacagaagccagaccaacaccctggccatcatcgagagcggcggcggcatcctgagaaacgtgagcagcctgatcgccaccaacgaggaccacagacagatcctgagagagaacaactgcctgcagaccctgctgcagcacctgaagagccacagcctgaccatcgtgagcaacgcctgcggcaccctgtggaacctgagcgccagaaaccccaaggaccaggaggccctgtgggacatgggcgccgtgagcatgctgaagaacctgatccacagcaagcacaagatgatcgccatgggcagcgccgccgccctgagaaacctgatggccaacagacccgccaagtacaaggacgccaacatcatgagccccggcagcagcctgcccagcctgcacgtgagaaagcagaaggccctggaggccgagctggacgcccagcacctgagcgagaccttcgacaacatcgacaacctgagccccaaggccagccacagaagcaagcagagacacaagcagagcctgtacggcgactacgtgttcgacaccaacagacacgacgacaacagaagcgacaacttcaacaccggcaacatgaccgtgctgagcccctacctgaacaccaccgtgctgcccagcagcagcagcagcagaggcagcctggacagcagcagaagcgagaaggacagaagcctggagagagagagaggcatcggcctgggcaactaccaccccgccaccgagaaccccggcaccagcagcaagagaggcctgcagatcagcaccaccgccgcccagatcgccaaggtgatggaggaggtgagcgccatccacaccagccaggaggacagaagcagcggcagcaccaccgagctgcactgcgtgaccgacgagagaaacgccctgagaagaagcagcgccgcccacacccacagcaacacctacaacttcaccaagagcgagaacagcaacagaacctgcagcatgccctacgccaagctggagtacaagagaagcagcaacgacagcctgaacagcgtgagcagcagcgacggctacggcaagagaggccagatgaagcccagcatcgagagctacagcgaggacgacgagagcaagttctgcagctacggccagtaccccgccgacctggcccacaagatccacagcgccaaccacatggacgacaacgacggcgagctggacacccccatcaactacagcctgaagtacagcgacgagcagctgaacagcggcagacagagccccagccagaacgagagatgggccagacccaagcacatcatcgaggacgagatcaagcagagcgagcagagacagagcagaaaccagagcaccacctaccccgtgtacaccgagagcaccgacgacaagcacctgaagttccagccccacttcggccagcaggagtgcgtgagcccctacagaagcagaggcgccaacggcagcgagaccaacagagtgggcagcaaccacggcatcaaccagaacgtgagccagagcctgtgccaggaggacgactacgaggacgacaagcccaccaactacagcgagagatacagcgaggaggagcagcacgaggaggaggagagacccaccaactacagcatcaagtacaacgaggagaagagacacgtggaccagcccatcgactacagcctgaagtacgccaccgacatccccagcagccagaagcagagcttcagcttcagcaagagcagcagcggccagagcagcaagaccgagcacatgagcagcagcagcgagaacaccagcacccccagcagcaacgccaagagacagaaccagctgcaccccagcagcgcccagagcagaagcggccagccccagaaggccgccacctgcaaggtgagcagcatcaaccaggagaccatccagacctactgcgtggaggacacccccatctgcttcagcagatgcagcagcctgagcagcctgagcagcgccgaggacgagatcggctgcaaccagaccacccaggaggccgacagcgccaacaccctgcagatcgccgagatcaaggagaagatcggcaccagaagcgccgaggaccccgtgagcgaggtgcccgccgtgagccagcaccccagaaccaagagcagcagactgcagggcagcagcctgagcagcgagagcgccagacacaaggccgtggagttcagcagcggcgccaagagccccagcaagagcggcgcccagacccccaagagcccccccgagcactacgtgcaggagacccccctgatgttcagcagatgcaccagcgtgagcagcctggacagcttcgagagcagaagcatcgccagcagcgtgcagagcgagccctgcagcggcatggtgagcggcatcatcagccccagcgacctgcccgacagccccggccagaccatgccccccagcagaagcaagaccccccccccccccccccagaccgcccagaccaagagagaggtgcccaagaacaaggcccccaccgccgagaagagagagagcggccccaagcaggccgccgtgaacgccgccgtgcagagagtgcaggtgctgcccgacgccgacaccctgctgcacttcgccaccgagagcacccccgacggcttcagctgcagcagcagcctgagcgccctgagcctggacgagcccttcatccagaaggacgtggagctgagaatcatgccccccgtgcaggagaacgacaacggcaacgagaccgagagcgagcagcccaaggagagcaacgagaaccaggagaaggaggccgagaagaccatcgacagcgagaaggacctgctggacgacagcgacgacgacgacatcgagatcctggaggagtgcatcatcagcgccatgcccaccaagagcagcagaaaggccaagaagcccgcccagaccgccagcaagctgcccccccccgtggccagaaagcccagccagctgcccgtgtacaagctgctgcccagccagaacagactgcagccccagaagcacgtgagcttcacccccggcgacgacatgcccagagtgtactgcgtggagggcacccccatcaacttcagcaccgccaccagcctgagcgacctgaccatcgagagcccccccaacgagctggccgccggcgagggcgtgagaggcggcgcccagagcggcgagttcgagaagagagacaccatccccaccgagggcagaagcaccgacgaggcccagggcggcaagaccagcagcgtgaccatccccgagctggacgacaacaaggccgaggagggcgacatcctggccgagtgcatcaacagcgccatgcccaagggcaagagccacaagcccttcagagtgaagaagatcatggaccaggtgcagcaggccagcgccagcagcagcgcccccaacaagaaccagctggacggcaagaagaagaagcccaccagccccgtgaagcccatcccccagaacaccgagtacagaaccagagtgagaaagaacgccgacagcaagaacaacctgaacgccgagagagtgttcagcgacaacaaggacagcaagaagcagaacctgaagaacaacagcaaggtgttcaacgacaagctgcccaacaacgaggacagagtgagaggcagcttcgccttcgacagcccccaccactacacccccatcgagggcaccccctactgcttcagcagaaacgacagcctgagcagcctggacttcgacgacgacgacgtggacctgagcagagagaaggccgagctgagaaaggccaaggagaacaaggagagcgaggccaaggtgaccagccacaccgagctgaccagcaaccagcagagcgccaacaagacccaggccatcgccaagcagcccatcaacagaggccagcccaagcccatcctgcagaagcagagcaccttcccccagagcagcaaggacatccccgacagaggcgccgccaccgacgagaagctgcagaacttcgccatcgagaacacccccgtgtgcttcagccacaacagcagcctgagcagcctgagcgacatcgaccaggagaacaacaacaaggagaacgagcccatcaaggagaccgagccccccgacagccagggcgagcccagcaagccccaggccagcggctacgcccccaagagcttccacgtggaggacacccccgtgtgcttcagcagaaacagcagcctgagcagcctgagcatcgacagcgaggacgacctgctgcaggagtgcatcagcagcgccatgcccaagaagaagaagcccagcagactgaagggcgacaacgagaagcacagccccagaaacatgggcggcatcctgggcgaggacctgaccctggacctgaaggacatccagagacccgacagcgagcacggcctgagccccgacagcgagaacttcgactggaaggccatccaggagggcgccaacagcatcgtgagcagcctgcaccaggccgccgccgccgcctgcctgagcagacaggccagcagcgacagcgacagcatcctgagcctgaagagcggcatcagcctgggcagccccttccacctgacccccgaccaggaggagaagcccttcaccagcaacaagggccccagaatcctgaagcccggcgagaagagcaccctggagaccaagaagatcgagagcgagagcaagggcatcaagggcggcaagaaggtgtacaagagcctgatcaccggcaaggtgagaagcaacagcgagatcagcggccagatgaagcagcccctgcaggccaacatgcccagcatcagcagaggcagaaccatgatccacatccccggcgtgagaaacagcagcagcagcaccagccccgtgagcaagaagggcccccccctgaagacccccgccagcaagagccccagcgagggccagaccgccaccaccagccccagaggcgccaagcccagcgtgaagagcgagctgagccccgtggccagacagaccagccagatcggcggcagcagcaaggcccccagcagaagcggcagcagagacagcacccccagcagacccgcccagcagcccctgagcagacccatccagagccccggcagaaacagcatcagccccggcagaaacggcatcagcccccccaacaagctgagccagctgcccagaaccagcagccccagcaccgccagcaccaagagcagcggcagcggcaagatgagctacaccagccccggcagacagatgagccagcagaacctgaccaagcagaccggcctgagcaagaacgccagcagcatccccagaagcgagagcgccagcaagggcctgaaccagatgaacaacggcaacggcgccaacaagaaggtggagctgagcagaatgagcagcaccaagagcagcggcagcgagagcgacagaagcgagagacccgtgctggtgagacagagcaccttcatcaaggaggcccccagccccaccctgagaagaaagctggaggagagcgccagcttcgagagcctgagccccagcagcagacccgccagccccaccagaagccaggcccagacccccgtgctgagccccagcctgcccgacatgagcctgagcacccacagcagcgtgcaggccggcggctggagaaagctgccccccaacctgagccccaccatcgagtacaacgacggcagacccgccaagagacacgacatcgccagaagccacagcgagagccccagcagactgcccatcaacagaagcggcacctggaagagagagcacagcaagcacagcagcagcctgcccagagtgagcacctggagaagaaccggcagcagcagcagcatcctgagcgccagcagcgagagcagcgagaaggccaagagcgaggacgagaagcacgtgaacagcatcagcggcaccaagcagagcaaggagaaccaggtgagcgccaagggcacctggagaaagatcaaggagaacgagttcagccccaccaacagcaccagccagaccgtgagcagcggcgccaccaacggcgccgagagcaagaccctgatctaccagatggcccccgccgtgagcaagaccgaggacgtgtgggtgagaatcgaggactgccccatcaacaaccccagaagcggcagaagccccaccggcaacaccccccccgtgatcgacagcgtgagcgagaaggccaaccccaacatcaaggacagcaaggacaaccaggccaagcagaacgtgggcaacggcagcgtgcccatgagaaccgtgggcctggagaacagactgaacagcttcatccaggtggacgcccccgaccagaagggcaccgagatcaagcccggccagaacaaccccgtgcccgtgagcgagaccaacgagagcagcatcgtggagagaacccccttcagcagcagcagcagcagcaagcacagcagccccagcggcaccgtggccgccagagtgacccccttcaactacaaccccagccccagaaagagcagcgccgacagcaccagcgccagacccagccagatccccacccccgtgaacaacaacaccaagaagagagacagcaagaccgacagcaccgagagcagcggcacccagagccccaagagacacagcggcagctacctggtgaccagcgtgtag

SEQ ID NO: 9279 - DNA, 8532 bp, Artificial Sequence; identical to SEQ ID NO: 9278
  Description of Artificial Sequence: Synthetic coding sequence

SEQ ID NO: 9280 - DNA, 8532 bp, Artificial Sequence; identical to SEQ ID NO: 9278
  Description of Artificial Sequence: Synthetic coding sequence

SEQ ID NO: 9281 - DNA, 864 bp, Artificial Sequence
  Description of Artificial Sequence: Synthetic coding sequence
atggccgccgccagctacgaccagctgctgaagcaggtggaggccctgaagatggagaacagcaacctgagacaggagctggaggacaacagcaaccacctgaccaagctggagaccgaggccagcaacatgaaggaggtgctgaagcagctgcagggcagcatcgaggacgaggccatggccagcagcggccagatcgacctgctggagagactgaaggagctgaacctggacagcagcaacttccccggcgtgaagctgagaagcaagatgagcctgagaagctacggcagcagagagggcagcgtgagcagcagaagcggcgagtgcagccccgtgcccatgggcagcttccccagaagaggcttcgtgaacggcagcagagagagcaccggctacctggaggagctggagaaggagagaagcctgctgctggccgacctggacaaggaggagaaggagaaggactggtactacgcccagctgcagaacctgaccaagagaatcgacagcctgcccctgaccgagaacttcagcctgcagaccgacatgaccagaagacagctggagtacgaggccagacagatcagagtggccatggaggagcagctgggcacctgccaggacatggagaagagagcccagagaagaatcgccagaatccagcagatcgagaaggacatcctgagaatcagacagctgctgcagagccaggccaccgaggccgagagaagcagccagaacaagcacgagaccggcagccacgacgccgagagacagaacgagggccagggcgtgggcgagatcaacatggccaccagcggcaacggccagatcgagaagatgagaatgttcgagtgctag

SEQ ID NO: 9282 - DNA, 357 bp, Artificial Sequence
  Description of Artificial Sequence: Synthetic coding sequence
atggccgccgccagctacgaccagctgctgaagcaggtggaggccctgaagatggagaacagcaacctgagacaggagctggaggacaacagcaaccacctgaccaagctggagaccgaggccagcaacatgaaggaggtgctgaagcagctgcagggcagcatcgaggacgaggccatggccagcagcggccagatcgacctgctggagagactgaaggagctgaacctggacagcagcaacttccccggcgtgaagctgagaagcaagatgagcctgagaagctacggcagcagagagggcagcgtgagcagcagaagcggcgagtgcagccccgtgcccatgggcagcttctag

SEQ ID NO: 9283 - DNA, 3918 bp, Artificial Sequence
  Description of Artificial Sequence: Synthetic coding sequence
atggccgccgccagctacgaccagctgctgaagcaggtggaggccctgaagatggagaacagcaacctgagacaggagctggaggacaacagcaaccacctgaccaagctggagaccgaggccagcaacatgaaggaggtgctgaagcagctgcagggcagcatcgaggacgaggccatggccagcagcggccagatcgacctgctggagagactgaaggagctgaacctggacagcagcaacttccccggcgtgaagctgagaagcaagatgagcctgagaagctacggcagcagagagggcagcgtgagcagcagaagcggcgagtgcagccccgtgcccatgggcagcttccccagaagaggcttcgtgaacggcagcagagagagcaccggctacctggaggagctggagaaggagagaagcctgctgctggccgacctggacaaggaggagaaggagaaggactggtactacgcccagctgcagaacctgaccaagagaatcgacagcctgcccctgaccgagaacttcagcctgcagaccgacatgaccagaagacagctggagtacgaggccagacagatcagagtggccatggaggagcagctgggcacctgccaggacatggagaagagagcccagagaagaatcgccagaatccagcagatcgagaaggacatcctgagaatcagacagctgctgcagagccaggccaccgaggccgagagaagcagccagaacaagcacgagaccggcagccacgacgccgagagacagaacgagggccagggcgtgggcgagatcaacatggccaccagcggcaacggccagggcagcaccaccagaatggaccacgagaccgccagcgtgctgagcagcagcagcacccacagcgcccccagaagactgaccagccacctgggcaccaaggtggagatggtgtacagcctgctgagcatgctgggcacccacgacaaggacgacatgagcagaaccctgctggccatgagcagcagccaggacagctgcatcagcatgagacagagcggctgcctgcccctgctgatccagctgctgcacggcaacgacaaggacagcgtgctgctgggcaacagcagaggcagcaaggaggccagagccagagccagcgccgccctgcacaacatcatccacagccagcccgacgacaagagaggcagaagagagatcagagtgctgcacctgctggagcagatcagagcctactgcgagacctgctgggagtggcaggaggcccacgagcccggcatggaccaggacaagaaccccatgcccgcccccgtggagcaccagatctgccccgccgtgtgcgtgctgatgaagctgagcttcgacgaggagcacagacacgccatgaacgagctgggcggcctgcaggccatcgccgagctgctgcaggtggactgcgagatgtacggcctgaccaacgaccactacagcatcaccctgagaagatacgccggcatggccctgaccaacctgaccttcggcgacgtggccaacaaggccaccctgtgcagcatgaagggctgcatgagagccctggtggcccagctgaagagcgagagcgaggacctgcagcaggtgatcgccagcgtgctgagaaacctgagctggagagccgacgtgaacagcaagaagaccctgagagaggtgggcagcgtgaaggccctgatggagtgcgccctggaggtgaagaaggagagcaccctgaagagcgtgctgagcgccctgtggaacctgagcgcccactgcaccgagaacaaggccgacatctgcgccgtggacggcgccctggccttcctggtgggcaccctgacctacagaagccagaccaacaccctggccatcatcgagagcggcggcggcatcctgagaaacgtgagcagcctgatcgccaccaacgaggaccacagacagatcctgagagagaacaactgcctgcagaccctgctgcagcacctgaagagccacagcctgaccatcgtgagcaacgcctgcggcaccctgtggaacctgagcgccagaaaccccaaggaccaggaggccctgtgggacatgggcgccgtgagcatgctgaagaacctgatccacagcaagcacaagatgatcgccatgggcagcgccgccgccctgagaaacctgatggccaacagacccgccaagtacaaggacgccaacatcatgagccccggcagcagcctgcccagcctgcacgtgagaaagcagaaggccctggaggccgagctggacgcccagcacctgagcgagaccttcgacaacatcgacaacctgagccccaaggccagccacagaagcaagcagagacacaagcagagcctgtacggcgactacgtgttcgacaccaacagacacgacgacaacagaagcgacaacttcaacaccggcaacatgaccgtgctgagcccctacctgaacaccaccgtgctgcccagcagcagcagcagcagaggcagcctggacagcagcagaagcgagaaggacagaagcctggagagagagagaggcatcggcctgggcaactaccaccccgccaccgagaaccccggcaccagcagcaagagaggcctgcagatcagcaccaccgccgcccagatcgccaaggtgatggaggaggtgagcgccatccacaccagccaggaggacagaagcagcggcagcaccaccgagctgcactgcgtgaccgacgagagaaacgccctgagaagaagcagcgccgcccacacccacagcaacacctacaacttcaccaagagcgagaacagcaacagaacctgcagcatgccctacgccaagctggagtacaagagaagcagcaacgacagcctgaacagcgtgagcagcagcgacggctacggcaagagaggccagatgaagcccagcatcgagagctacagcgaggacgacgagagcaagttctgcagctacggccagtaccccgccgacctggcccacaagatccacagcgccaaccacatggacgacaacgacggcgagctggacacccccatcaactacagcctgaagtacagcgacgagcagctgaacagcggcagacagagccccagccagaacgagagatgggccagacccaagcacatcatcgaggacgagatcaagcagagcgagcagagacagagcagaaaccagagcaccacctaccccgtgtacaccgagagcaccgacgacaagcacctgaagttccagccccacttcggccagcaggagtgcgtgagcccctacagaagcagaggcgccaacggcagcgagaccaacagagtgggcagcaaccacggcatcaaccagaacgtgagccagagcctgtgccaggaggacgactacgaggacgacaagcccaccaactacagcgagagatacagcgaggaggagcagcacgaggaggaggagagacccaccaactacagcatcaagtacaacgaggagaagagacacgtggaccagcccatcgactacagcctgaagtacgccaccgacatccccagcagccagaagcagagcttcagcttcagcaagagcagcagcggccagagcagcaagaccgagcacatgagcagcagcagcgagaacaccagcacccccagcagcaacgccaagagacagaaccagctgcaccccagcagcgcccagagcagaagcggccagccccagaaggccgccacctgcaaggtgagcagcatcaaccaggagaccatccagacctactgcgtggaggacacccccatctgcttcagcagatgcagcagcctgagcagcctgagcagcgccgaggacgagatcggctgcaaccagaccacccaggaggccgacagcgccaacaccctgcagatcgcctag

SEQ ID NO: 9284 - DNA, 2796 bp, Artificial Sequence
  Description of Artificial Sequence: Synthetic coding sequence
atggccgagatcaaggagaagatctgcgactacctgttcaacgtgagcgacagcagcgccctgaacctggccaagaacatcggcctgaccaaggccagagacatcaacgccgtgctgatcgacatggagagacagggcgacgtgtacagacagggcaccaccccccccatctggcacctgaccgacaagaagagagagagaatgcagatcaagagaaacaccaacagcgtgcccgagaccgcccccgccgccatccccgagaccaagagaaacgccgagttcctgacctgcaacatccccaccagcaacgccagcaacaacatggtgaccaccgagaaggtggagaacggccaggagcccgtgatcaagctggagaacagacaggaggccagacccgagcccgccagactgaagccccccgtgcactacaacggccccagcaaggccggctacgtggacttcgagaacggccagtgggccaccgacgacatccccgacgacctgaacagcatcagagccgcccccggcgagttcagagccatcatggagatgcccagcttctacagccacggcctgcccagatgcagcccctacaagaagctgaccgagtgccagctgaagaaccccatcagcggcctgctggagtacgcccagttcgccagccagacctgcgagttcaacatgatcgagcagagcggccccccccacgagcccagattcaagttccaggtggtgatcaacggcagagagttcccccccgccgaggccggcagcaagaaggtggccaagcaggacgccgccatgaaggccatgaccatcctgctggaggaggccaaggccaaggacagcggcaagagcgaggagagcagccactacagcaccgagaaggagagcgagaagaccgccgagagccagacccccacccccagcgccaccagcttcttcagcggcaagagccccgtgaccaccctgctggagtgcatgcacaagctgggcaacagctgcgagttcagactgctgagcaaggagggccccgcccacgagcccaagttccagtactgcgtggccgtgggcgcccagaccttccccagcgtgagcgcccccagcaagaaggtggccaagcagatggccgccgaggaggccatgaaggccctgcacggcgaggccaccaacagcatggccagcgacaaccagcccgagggcatgatcagcgagagcctggacaacctggagagcatgatgcccaacaaggtgagaaagatcggcgagctggtgagatacctgaacaccaaccccgtgggcggcctgctggagtacgccagaagccacggcttcgccgccgagttcaagctggtggaccagagcggccccccccacgagcccaagttcgtgtaccaggccaaggtgggcggcagatggttccccgccgtgtgcgcccacagcaagaagcagggcaagcaggaggccgccgacgccgccctgagagtgctgatcggcgagaacgagaaggccgagagaatgggcttcaccgaggtgacccccgtgaccggcgccagcctgagaagaaccatgctgctgctgagcagaagccccgaggcccagcccaagaccctgcccctgaccggcagcaccttccacgaccagatcgccatgctgagccacagatgcttcaacaccctgaccaacagcttccagcccagcctgctgggcagaaagatcctggccgccatcatcatgaagaaggacagcgaggacatgggcgtggtggtgagcctgggcaccggcaacagatgcgtgaagggcgacagcctgagcctgaagggcgagaccgtgaacgactgccacgccgagatcatcagcagaagaggcttcatcagattcctgtacagcgagctgatgaagtacaacagccagaccgccaaggacagcatcttcgagcccgccaagggcggcgagaagctgcagatcaagaagaccgtgagcttccacctgtacatcagcaccgccccctgcggcgacggcgccctgttcgacaagagctgcagcgacagagccatggagagcaccgagagcagacactaccccgtgttcgagaaccccaagcagggcaagctgagaaccaaggtggagaacggcgagggcaccatccccgtggagagcagcgacatcgtgcccacctgggacggcatcagactgggcgagagactgagaaccatgagctgcagcgacaagatcctgagatggaacgtgctgggcctgcagggcgccctgctgacccacttcctgcagcccatctacctgaagagcgtgaccctgggctacctgttcagccagggccacctgaccagagccatctgctgcagagtgaccagagacggcagcgccttcgaggacggcctgagacaccccttcatcgtgaaccaccccaaggtgggcagagtgagcatctacgacagcaagagacagagcggcaagaccaaggagaccagcgtgaactggtgcctggccgacggctacgacctggagatcctggacggcaccagaggcaccgtggacggccccagaaacgagctgagcagagtgagcaagaagaacatcttcctgctgttcaagaagctgtgcagcttcagatacagaagagacctgctgagactgagctacggcgaggccaagaaggccgccagagactacgagaccgccaagaactacttcaagaagggcctgaaggacatgggctacggcaactggatcagcaagccccaggaggagaagaacttctacctgtgccccgtgtag

SEQ ID NO: 9285 - DNA, 3681 bp, Artificial Sequence
  Description of Artificial Sequence: Synthetic coding sequence
atgaaccccagacagggctacagcctgagcggctactacacccaccccttccagggctacgagcacagacagctgagataccagcagcccggccccggcagcagccccagcagcttcctgctgaagcagatcgagttcctgaagggccagctgcccgaggcccccgtgatcggcaagcagacccccagcctgccccccagcctgcccggcctgagacccagattccccgtgctgctggccagcagcaccagaggcagacaggtggacatcagaggcgtgcccagaggcgtgcacctgagaagccagggcctgcagagaggcttccagcaccccagccccagaggcagaagcctgccccagagaggcgtggactgcctgagcagccacttccaggagctgagcatctaccaggaccaggagcagagaatcctgaagttcctggaggagctgggcgagggcaaggccaccaccgcccacgacctgagcggcaagctgggcacccccaagaaggagatcaacagagtgctgtacagcctggccaagaagggcaagctgcagaaggaggccggcaccccccccctgtggaagatcgccgtgagcacccaggcctggaaccagcacagcggcgtggtgagacccgacggccacagccagggcgcccccaacagcgaccccagcctggagcccgaggacagaaacagcaccagcgtgagcgaggacctgctggagcccttcatcgccgtgagcgcccaggcctggaaccagcacagcggcgtggtgagacccgacagccacagccagggcagccccaacagcgaccccggcctggagcccgaggacagcaacagcaccagcgccctggaggaccccctggagttcctggacatggccgagatcaaggagaagatctgcgactacctgttcaacgtgagcgacagcagcgccctgaacctggccaagaacatcggcctgaccaaggccagagacatcaacgccgtgctgatcgacatggagagacagggcgacgtgtacagacagggcaccaccccccccatctggcacctgaccgacaagaagagagagagaatgcagatcaagagaaacaccaacagcgtgcccgagaccgcccccgccgccatccccgagaccaagagaaacgccgagttcctgacctgcaacatccccaccagcaacgccagcaacaacatggtgaccaccgagaaggtggagaacggccaggagcccgtgatcaagctggagaacagacaggaggccagacccgagcccgccagactgaagccccccgtgcactacaacggccccagcaaggccggctacgtggacttcgagaacggccagtgggccaccgacgacatccccgacgacctgaacagcatcagagccgcccccggcgagttcagagccatcatggagatgcccagcttctacagccacggcctgcccagatgcagcccctacaagaagctgaccgagtgccagctgaagaaccccatcagcggcctgctggagtacgcccagttcgccagccagacctgcgagttcaacatgatcgagcagagcggccccccccacgagcccagattcaagttccaggtggtgatcaacggcagagagttcccccccgccgaggccggcagcaagaaggtggccaagcaggacgccgccatgaaggccatgaccatcctgctggaggaggccaaggccaaggacagcggcaagagcgaggagagcagccactacagcaccgagaaggagagcgagaagaccgccgagagccagacccccacccccagcgccaccagcttcttcagcggcaagagccccgtgaccaccctgctggagtgcatgcacaagctgggcaacagctgcgagttcagactgctgagcaaggagggccccgcccacgagcccaagttccagtactgcgtggccgtgggcgcccagaccttccccagcgtgagcgcccccagcaagaaggtggccaagcagatggccgccgaggaggccatgaaggccctgcacggcgaggccaccaacagcatggccagcgacaaccagcccgagggcatgatcagcgagagcctggacaacctggagagcatgatgcccaacaaggtgagaaagatcggcgagctggtgagatacctgaacaccaaccccgtgggcggcctgctggagtacgccagaagccacggcttcgccgccgagttcaagctggtggaccagagcggccccccccacgagcccaagttcgtgtaccaggccaaggtgggcggcagatggttccccgccgtgtgcgcccacagcaagaagcagggcaagcaggaggccgccgacgccgccctgagagtgctgatcggcgagaacgagaaggccgagagaatgggcttcaccgaggtgacccccgtgaccggcgccagcctgagaagaaccatgctgctgctgagcagaagccccgaggcccagcccaagaccctgcccctgaccggcagcaccttccacgaccagatcgccatgctgagccacagatgcttcaacaccctgaccaacagcttccagcccagcctgctgggcagaaagatcctggccgccatcatcatgaagaaggacagcgaggacatgggcgtggtggtgagcctgggcaccggcaacagatgcgtgaagggcgacagcctgagcctgaagggcgagaccgtgaacgactgccacgccgagatcatcagcagaagaggcttcatcagattcctgtacagcgagctgatgaagtacaacagccagaccgccaaggacagcatcttcgagcccgccaagggcggcgagaagctgcagatcaagaagaccgtgagcttccacctgtacatcagcaccgccccctgcggcgacggcgccctgttcgacaagagctgcagcgacagagccatggagagcaccgagagcagacactaccccgtgttcgagaaccccaagcagggcaagctgagaaccaaggtggagaacggcgagggcaccatccccgtggagagcagcgacatcgtgcccacctgggacggcatcagactgggcgagagactgagaaccatgagctgcagcgacaagatcctgagatggaacgtgctgggcctgcagggcgccctgctgacccacttcctgcagcccatctacctgaagagcgtgaccctgggctacctgttcagccagggccacctgaccagagccatctgctgcagagtgaccagagacggcagcgccttcgaggacggcctgagacaccccttcatcgtgaaccaccccaaggtgggcagagtgagcatctacgacagcaagagacagagcggcaagaccaaggagaccagcgtgaactggtgcctggccgacggctacgacctggagatcctggacggcaccagaggcaccgtggacggccccagaaacgagctgagcagagtgagcaagaagaacatcttcctgctgttcaagaagctgtgcagcttcagatacagaagagacctgctgagactgagctacggcgaggccaagaaggccgccagagactacgagaccgccaagaactacttcaagaagggcctgaaggacatgggctacggcaactggatcagcaagccccaggaggagaagaacttctacctgtgccccgtgtag

SEQ ID NO: 9286 - DNA, 3588 bp, Artificial Sequence
  Description of Artificial Sequence: Synthetic coding sequence
ggctacagcctgagcggctactacacccaccccttccagggctacgagcacagacagctgagataccagcagcccggccccggcagcagccccagcagcttcctgctgaagcagatcgagttcctgaagggccagctgcccgaggcccccgtgatcggcaagcagacccccagcctgccccccagcctgcccggcctgagacccagattccccgtgctgctggccagcagcaccagaggcagacaggtggacatcagaggcgtgcccagaggcgtgcacctgagaagccagggcctgcagagaggcttccagcaccccagccccagaggcagaagcctgccccagagaggcgtggactgcctgagcagccacttccaggagctgagcatctaccaggaccaggagcagagaatcctgaagttcctggaggagctgggcgagggcaaggccaccaccgcccacgacctgagcggcaagctgggcacccccaagaaggagatcaacagagtgctgtacagcctggccaagaagggcaagctgcagaaggaggccggcaccccccccctgtggaagatcgccgtgagcacccaggcctggaaccagcacagcggcgtggtgagacccgacggccacagccagggcgcccccaacagcgaccccagcctggagcccgaggacagaaacagcaccagcgtgagcgaggacctgctggagcccttcatcgccgtgagcgcccaggcctggaaccagcacagcggcgtggtgagacccgacagccacagccagggcagccccaacagcgaccccggcctggagcccgaggacagcaacagcaccagcgccctggaggaccccctggagttcctggacatggccgagatcaaggagaagatctgcgactacctgttcaacgtgagcgacagcagcgccctgaacctggccaagaacatcggcctgaccaaggccagagacatcaacgccgtgctgatcgacatggagagacagggcgacgtgtacagacagggcaccaccccccccatctggcacctgaccgacaagaagagagagagaatgcagatcaagagaaacaccaacagcgtgcccgagaccgcccccgccgccatccccgagaccaagagaaacgccgagttcctgacctgcaacatccccaccagcaacgccagcaacaacatggtgaccaccgagaaggtggagaacggccaggagcccgtgatcaagctggagaacagacaggaggccagacccgagcccgccagactgaagccccccgtgcactacaacggccccagcaaggccggctacgtggacttcgagaacggccagtgggccaccgacgacatccccgacgacctgaacagcatcagagccgcccccggcgagttcagagccatcatggagatgcccagcttctacagccacggcctgcccagatgcagcccctacaagaagctgaccgagtgccagctgaagaaccccatcagcggcctgctggagtacgcccagttcgccagccagacctgcgagttcaacatgatcgagcagagcggccccccccacgagcccagattcaagttccaggtggtgatcaacggcagagagttcccccccgccgaggccggcagcaagaaggtggccaagcaggacgccgccatgaaggccatgaccatcctgctggaggaggccaaggccaaggacagcggcaagagcgaggagagcagccactacagcaccgagaaggagagcgagaagaccgccgagagccagacccccacccccagcgccaccagcttcttcagcggcaagagccccgtgaccaccctgctggagtgcatgcacaagctgggcaacagctgcgagttcagactgctgagcaaggagggccccgcccacgagcccaagttccagtactgcgtggccgtgggcgcccagaccttccccagcgtgagcgcccccagcaagaaggtggccaagcagatggccgccgaggaggccatgaaggccctgcacggcgaggccaccaacagcatggccagcgacaaccagcccgagggcatgatcagcgagagcctggacaacctggagagcatgatgcccaacaaggtgagaaagatcggcgagctggtgagatacctgaacaccaaccccgtgggcggcctgctggagtacgccagaagccacggcttcgccgccgagttcaagctggtggaccagagcggccccccccacgagcccaagttcgtgtaccaggccaaggtgggcggcagatggttccccgccgtgtgcgcccacagcaagaagcagggcaagcaggaggccgccgacgccgccctgagagtgctgatcggcgagaacgagaaggccgagagaatgggcttcaccgagctgcccctgaccggcagcaccttccacgaccagatcgccatgctgagccacagatgcttcaacaccctgaccaacagcttccagcccagcctgctgggcagaaagatcctggccgccatcatcatgaagaaggacagcgaggacatgggcgtggtggtgagcctgggcaccggcaacagatgcgtgaagggcgacagcctgagcctgaagggcgagaccgtgaacgactgccacgccgagatcatcagcagaagaggcttcatcagattcctgtacagcgagctgatgaagtacaacagccagaccgccaaggacagcatcttcgagcccgccaagggcggcgagaagctgcagatcaagaagaccgtgagcttccacctgtacatcagcaccgccccctgcggcgacggcgccctgttcgacaagagctgcagcgacagagccatggagagcaccgagagcagacactaccccgtgttcgagaaccccaagcagggcaagctgagaaccaaggtggagaacggcgagggcaccatccccgtggagagcagcgacatcgtgcccacctgggacggcatcagactgggcgagagactgagaaccatgagctgcagcgacaagatcctgagatggaacgtgctgggcctgcagggcgccctgctgacccacttcctgcagcccatctacctgaagagcgtgaccctgggctacctgttcagccagggccacctgaccagagccatctgctgcagagtgaccagagacggcagcgccttcgaggacggcctgagacaccccttcatcgtgaaccaccccaaggtgggcagagtgagcatctacgacagcaagagacagagcggcaagaccaaggagaccagcgtgaactggtgcctggccgacggctacgacctggagatcctggacggcaccagaggcaccgtggacggccccagaaacgagctgagcagagtgagcaagaagaacatcttcctgctgttcaagaagctgtgcagcttcagatacagaagagacctgctgagactgagctacggcgaggccaagaaggccgccagagactacgagaccgccaagaactacttcaagaagggcctgaaggacatgggctacggcaactggatcagcaagccccaggaggagaagaacttctacctgtgccccgtgtag

SEQ ID NO: 9287 - DNA, 528 bp, Artificial Sequence
  Description of Artificial Sequence: Synthetic coding sequence
atgggcaaggtgctgagcaagatcttcggcaacaaggagatgagaatcctgatgctgggcctggacgccgccggcaagaccaccatcctgtacaagctgaagctgggccagagcgtgaccaccatccccaccgtgggcttcaacgtggagaccgtgacctacaagaacgtgaagttcaacgtgtgggacgtgggcggccaggacaagatcagacccctgtggagacactactacaccggcacccagggcctgatcttcgtggtggactgcgccgacagagacagaatcgacgaggccagacaggagctgcacagaatcatcaacgacagagagatgagagacgccatcatcctgatcttcgccaacaagcaggacctgcccgacgccatgaagccccacgagatccaggagaagctgggcctgaccagaatcagagacagaaactggtacgtgcagcccagctgcgccaccagcggcgacggcctgtacgagggcctgacctggctgaccagcaactacaagagctag

SEQ ID NO: 9288 - DNA, 1398 bp, Artificial Sequence
  Description of Artificial Sequence: Synthetic coding sequence
atgttcagacaggagcagcccctggccgagggcagcttcgcccccatgggcagcctgcagcccgacgccggcaacgccagctggaacggcaccgaggcccccggcggcggcgccagagccaccccctacagcctgcaggtgaccctgaccctggtgtgcctggccggcctgctgatgctgctgaccgtgttcggcaacgtgctggtgatcatcgccgtgttcaccagcagagccctgaaggccccccagaacctgttcctggtgagcctggccagcgccgacatcctggtggccaccctggtgatccccttcagcctggccaacgaggtgatgggctactggtacttcggcaaggcctggtgcgagatctacctggccctggacgtgctgttctgcaccagcagcatcgtgcacctgtgcgccatcagcctggacagatactggagcatcacccaggccatcgagtacaacctgaagagaacccccagaagaatcaaggccatcatcatcaccgtgtgggtgatcagcgccgtgatcagcttcccccccctgatcagcatcgagaagaagggcggcggcggcggcccccagcccgccgagcccagatgcgagatcaacgaccagaagtggtacgtgatcagcagctgcatcggcagcttcttcgccccctgcctgatcatgatcctggtgtacgtgagaatctaccagatcgccaagagaagaaccagagtgccccccagcagaagaggccccgacgccgtggccgccccccccggcggcaccgagagaagacccaacggcctgggccccgagagaagcgccggccccggcggcgccgaggccgagcccctgcccacccagctgaacggcgcccccggcgagcccgcccccgccggccccagagacaccgacgccctggacctggaggagagcagcagcagcgaccacgccgagagaccccccggccccagaagacccgagagaggccccagaggcaagggcaaggccagagccagccaggtgaagcccggcgacagcctgcccagaagaggccccggcgccaccggcatcggcacccccgccgccggccccggcgaggagagagtgggcgccgccaaggccagcagatggagaggcagacagaacagagagaagagattcaccttcgtgctggccgtggtgatcggcgtgttcgtggtgtgctggttccccttcttcttcacctacaccctgaccgccgtgggctgcagcgtgcccagaaccctgttcaagttcttcttctggttcggctactgcaacagcagcctgaaccccgtgatctacaccatcttcaaccacgacttcagaagagccttcaagaagatcctgtgcagaggcgacagaaagagaatcgtgtag

SEQ ID NO: 9289 - DNA, 285 bp, Artificial Sequence
  Description of Artificial Sequence: Synthetic coding sequence
atggcccccctgaagatgctggccctggtgaccctgctgctgggcgccagcctgcagcacatccacgccgccagaggcaccaacgtgggcagagagtgctgcctggagtacttcaagggcgccatccccctgagaaagctgaagacctggtaccagaccagcgaggactgcagcagagacgccatcgtgttcgtgaccgtgcagggcagagccatctgcagcgaccccaacaacaagagagtgaagaacgccgtgaagtacctgcagagcctggagagaagctag

SEQ ID NO: 9290 - DNA, 1635 bp, Artificial Sequence
  Description of Artificial Sequence: Synthetic coding sequence
atgcccggcagatgccagagcgacgccgccatgagagtgaacggccccgccagcagagcccccgccggctggaccagcggcagcctgcacaccggccccagagccggcagacccagagcccaggccagaggcgtgagaggcagaggcctgctgctgagacccagacccgccaaggagctgcccctgcccagaaagggcggcgcctgggcccccgccggcaaccccggccccctgcaccccctgggcgtggccgtgggcatggccggcagcggcagactggtgctgagaccctggatcagagagctgatcctgggcagcgagacccccagcagccccagagccggccagctgctggaggtgctgcaggacgccgaggccgccgtggccggccccagccacgcccccgacaccagcgacgtgggcgccaccctgctggtgagcgacggcacccacagcgtgagatgcctggtgaccagagaggccctggacaccagcgactgggaggagaaggagttcggcttcagaggcaccgagggcagactgctgctgctgcaggactgcggcgtgcacgtgcaggtggccgagggcggcgcccccgccgagttctacctgcaggtggacagattcagcctgctgcccaccgagcagcccagactgagagtgcccggctgcaaccaggacctggacgtgcagaagaagctgtacgactgcctggaggagcacctgagcgagagcaccagcagcaacgccggcctgagcctgagccagctgctggacgagatgagagaggaccaggagcaccagggcgccctggtgtgcctggccgagagctgcctgaccctggagggcccctgcaccgccccccccgtgacccactgggccgccagcagatgcaaggccaccggcgaggccgtgtacaccgtgcccagcagcatgctgtgcatcagcgagaacgaccagctgatcctgagcagcctgggcccctgccagagaacccagggccccgagctgcccccccccgaccccgccctgcaggacctgagcctgaccctgatcgccagcccccccagcagccccagcagcagcggcacccccgccctgcccggccacatgagcagcgaggagagcggcaccagcatcagcctgctgcccgccctgagcctggccgcccccgaccccggccagagaagcagcagccagcccagccccgccatctgcagcgcccccgccaccctgacccccagaagcccccacgccagcagaacccccagcagccccctgcagagctgcacccccagcctgagccccagaagccacgtgcccagcccccaccaggccctggtgaccagaccccagaagcccagcctggagttcaaggagttcgtgggcctgccctgcaagaacagaccccccttccccagaaccggcgccaccagaggcgcccaggagccctgcagcgtgtgggagccccccaagagacacagagacggcagcgccttccagtacgagtacgagcccccctgcaccagcctgtgcgccagagtgcaggccgtgagactgcccccccagctgatggcctgggccctgcacttcctgatggacgcccagcccggcagcgagcccacccccatgtag

SEQ ID NO: 9291 - DNA, 558 bp, Artificial Sequence
  Description of Artificial Sequence: Synthetic coding sequence
atgaagctggtgagcgtggccctgatgtacctgggcagcctggccttcctgggcgccgacaccgccagactggacgtggccagcgagttcagaaagaagtggaacaagtgggccctgagcagaggcaagagagagctgagaatgagcagcagctaccccaccggcctggccgacgtgaaggccggccccgcccagaccctgatcagaccccaggacatgaagggcgccagcagaagccccgaggacagcagccccgacgccgccagaatcagagtgaagagatacagacagagcatgaacaacttccagggcctgagaagcttcggctgcagattcggcacctgcaccgtgcagaagctggcccaccagatctaccagttcaccgacaaggacaaggacaacgtggcccccagaagcaagatcagcccccagggctacggcagaagaagaagaagaagcctgcccgaggccggccccggcagaaccctggtgagcagcaagccccaggcccacggcgcccccgccccccccagcggcagcgccccccacttcctgtag

SEQ ID NO: 9292 - DNA, 558 bp, Artificial Sequence; identical to SEQ ID NO: 9291
  Description of Artificial Sequence: Synthetic coding sequence

SEQ ID NO: 9293 - DNA, 558 bp, Artificial Sequence; identical to SEQ ID NO: 9291
  Description of Artificial Sequence: Synthetic coding sequence

SEQ ID NO: 9294 - DNA, 702 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtggtggaggagagcagaagaagcagaaagagaccctgcgagcaggaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacactag

SEQ ID NO: 9295 - DNA, 1029 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacgtgagcgacctggagagaggcgccggcagaaccagaagaggcggcgccaactgcagactgtgcggcagaatcagagccggcaacagcagccccggccccggcgaccccggcagacccggcgacagcagacccgcccactggggccacctggtggccaaggccgccacccccagaagaggcgaggagggccccagaaagcccggcggcagaggcggcgcctgcagaaccgagagcgtgggcggcacctag

SEQ ID NO: 9296 - DNA, 1044 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcgagggcttcgacaaggtgagagaggccgaggacagcccccagcacatgtag

SEQ ID NO: 9297 - DNA, 1215 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 9298 - DNA, 705 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagaagcctgagaaccttcaccatcaccgccagcgactggatcttcccccccagcgagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagatag

SEQ ID NO: 9299 - DNA, 402 bp, Artificial Sequence
  Description of Artificial Sequence: Synthetic coding sequence
atgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 9300 - DNA, 1308 bp, Artificial Sequence
  Description of Artificial Sequence: Synthetic coding sequence
atgggcgccggcgagagagtgcaggccccccccagagccgaggccaccgccggcagaggcgccgacagagccagaaccctggagggcagcagaatggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 9301 - DNA, 387 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagttcgagaacctgcacaactacagcctgtag

SEQ ID NO: 9302 - DNA, 462 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 9303 - DNA, 885 bp, Artificial Sequence
  Description of Artificial Sequence: Synthetic coding sequence
atgaacagaaacggcaaggagaccaagagcaactacagagtgagagtgtaccagatccccggcaagcccgagatcgtggacagcgccagcgagctgaccgccggcgtgcccaacaaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcggcagcgtgggcggcagcggcctgggcaccctggccctggccctgggcatcctgggcggcctgggcaccgccgccctgctgatcggcgtgatcctgtggcagagaagacagagaagaggcgaggagagaaaggcccccgagaaccaggaggaggaggaggagagagccgagctgaaccagagcgaggagcccgaggccggcgagagcagcaccggcggcccctag

SEQ ID NO: 9304 - DNA, 366 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactggtggtggagccagaaggtggagcagtag

SEQ ID NO: 9305 - DNA, 1092 bp, Artificial Sequence
  Description of Artificial Sequence: Synthetic coding sequence
atggccgccggcaccgccgtgggcgcctgggtgctggtgctgagcctgtggggcgccgtggtgggcgcccagaacatcaccgccagaatcggcgagcccctggtgctgaagtgcaagggcgcccccaagaagcccccccagagactggagtggaagctgaacaccggcagaaccgaggcctggaaggtgctgagcccccagggcggcggcccctgggacagcgtggccagagtgctgcccaacagcagcctgttcctgcccgccgtgggcatccaggacgagggcatcttcagatgccaggccatgaacagaaacggcaaggagaccaagagcaactacagagtgagagtgtaccagatccccggcaagcccgagatcgtggacagcgccagcgagctgaccgccggcgtgcccaacaaggtggtggaggagagcagaagaagcagaaagagaccctgcgagcaggaggtgggcacctgcgtgagcgagggcagctaccccgccggcaccctgagctggcacctggacggcaagcccctggtgcccaacgagaagggcgtgagcgtgaaggagcagaccagaagacaccccgagaccggcctgttcaccctgcagagcgagctgatggtgacccccgccagaggcggcgaccccagacccaccttcagctgcagcttcagccccggcctgcccagacacagagccctgagaaccgcccccatccagcccagagtgtgggagcccgtgcccctggaggaggtgcagctggtggtggagcccgagggcggcgccgtggcccccggcggcaccgtgaccctgacctgcgaggtgcccgcccagcccagcccccagatccactggatgaaggacggcgtgcccctgcccctgccccccagccccgtgctgatcctgcccgagatcggcccccaggaccagggcacctacagctgcgtggccacccacagcagccacggcccccaggagagcagagccgtgagcatcagcatcatcgagcccggcgaggagggccccaccgccggcgagggcttcgacaaggtgagagaggccgaggacagcccccagcacatgtag

SEQ ID NO: 9306 - DNA, 3633 bp, Artificial Sequence
  Description of Artificial Sequence: Synthetic coding sequence
atggccgcccagagcagcctgtacaacgacgacagaaacctgctgagaatcagagagaaggagagaagaaaccaggaggcccaccaggagaaggaggccttccccgagaagatccccctgttcggcgagccctacaagaccgccaagggcgacgagctgagcagcagaatccagaacatgctgggcaactacgaggaggtgaaggagttcctgagcaccaagagccacacccacagactggacgccagcgagaacagactgggcaagcccaagtaccccctgatccccgacaagggcagcagcatccccagcagcagcttccacaccagcgtgcaccaccagagcatccacacccccgccagcggccccctgagcgtgggcaacatcagccacaaccccaagatggcccagcccagaaccgagcccatgcccagcctgcacgccaagagctgcggcccccccgacagccagcacctgacccaggacagactgggccaggagggcttcggcagcagccaccacaagaagggcgacagaagagccgacggcgaccactgcgccagcgtgaccgacagcgcccccgagagagagctgagccccctgatcagcctgcccagccccgtgccccccctgagccccatccacagcaaccagcagaccctgcccagaacccagggcagcagcaaggtgcacggcagcagcaacaacagcaagggctactgccccgccaagagccccaaggacctggccgtgaaggtgcacgacaaggagaccccccaggacagcctggtggcccccgcccagccccccagccagaccttccccccccccagcctgcccagcaagagcgtggccatgcagcagaagcccaccgcctacgtgagacccatggacggccaggaccaggcccccagcgagagccccgagctgaagcccctgcccgaggactacagacagcagaccttcgagaagaccgacctgaaggtgcccgccaaggccaagctgaccaagctgaagatgcccagccagagcgtggagcagacctacagcaacgaggtgcactgcgtggaggagatcctgaaggagatgacccacagctggcccccccccctgaccgccatccacacccccagcaccgccgagcccagcaagttccccttccccaccaaggacagccagcacgtgagcagcgtgacccagaaccagaagcagtacgacaccagcagcaagacccacagcaacagccagcagggcaccagcagcatgctggaggacgacctgcagctgagcgacagcgaggacagcgacagcgagcagacccccgagaagccccccagcagcagcgccccccccagcgccccccagagcctgcccgagcccgtggccagcgcccacagcagcagcgccgagagcgagagcaccagcgacagcgacagcagcagcgacagcgagagcgagagcagcagcagcgacagcgaggagaacgagcccctggagacccccgcccccgagcccgagccccccaccaccaacaagtggcagctggacaactggctgaccaaggtgagccagcccgccgccccccccgagggccccagaagcaccgagccccccagaagacaccccgagagcaagggcagcagcgacagcgccaccagccaggagcacagcgagagcaaggaccccccccccaagagcagcagcaaggcccccagagccccccccgaggccccccaccccggcaagagaagctgccagaagagccccgcccagcaggagcccccccagagacagaccgtgggcaccaagcagcccaagaagcccgtgaaggccagcgccagagccggcagcagaaccagcctgcagggcgagagagagcccggcctgctgccctacggcagcagagaccagaccagcaaggacaagcccaaggtgaagaccaagggcagacccagagccgccgccagcaacgagcccaagcccgccgtgccccccagcagcgagaagaagaagcacaagagcagcctgcccgcccccagcaaggccctgagcggccccgagcccgccaaggacaacgtggaggacagaacccccgagcacttcgccctggtgcccctgaccgagagccagggccccccccacagcggcagcggcagcagaaccagcggctgcagacaggccgtggtggtgcaggaggacagcagaaaggacagactgcccctgcccctgagagacaccaagctgctgagccccctgagagacaccccccccccccagagcctgatggtgaagatcaccctggacctgctgagcagaatcccccagccccccggcaagggcagcagacagagaaaggccgaggacaagcagccccccgccggcaagaagcacagcagcgagaagagaagcagcgacagcagcagcaagctggccaagaagagaaagggcgaggccgagagagactgcgacaacaagaagatcagactggagaaggagatcaagagccagagcagcagcagcagcagcagccacaaggagagcagcaagaccaagcccagcagacccagcagccagagcagcaagaaggagatgctgccccccccccccgtgagcagcagcagccagaagcccgccaagcccgccctgaagagaagcagaagagaggccgacacctgcggccaggacccccccaagagcgccagcagcaccaagagcaaccacaaggacagcagcatccccaagcagagaagagtggagggcaagggcagcagaagcagcagcgagcacaagggcagcagcggcgacaccgccaaccccttccccgtgcccagcctgcccaacggcaacagcaagcccggcaagccccaggtgaagttcgacaagcagcaggccgacctgcacatgagagaggccaagaagatgaagcagaaggccgagctgatgaccgacagagtgggcaaggccttcaagtacctggaggccgtgctgagcttcatcgagtgcggcatcgccaccgagagcgagagccagagcagcaagagcgcctacagcgtgtacagcgagaccgtggacctgatcaagttcatcatgagcctgaagagcttcagcgacgccaccgcccccacccaggagaagatcttcgccgtgctgtgcatgagatgccagagcatcctgaacatggccatgttcagatgcaagaaggacatcgccatcaagtacagcagaaccctgaacaagcacttcgagagcagcagcaaggtggcccaggcccccagcccctgcatcgccagcaccggcacccccagccccctgagccccatgcccagccccgccagcagcgtgggcagccagagcagcgccggcagcgtgggcagcagcggcgtggccgccaccatcagcacccccgtgaccatccagaacatgaccagcagctacgtgaccatcaccagccacgtgctgaccgccttcgacctgtgggagcaggccgaggccctgaccagaaagaacaaggagttcttcgccagactgagcaccaacgtgtgcaccctggccctgaacagcagcctggtggacctggtgcactacaccagacagggcttccagcagctgcaggagctgaccaagaccccctag

SEQ ID NO: 9307 - DNA, 1266 bp, Artificial Sequence
  Description of Artificial Sequence: Synthetic coding sequence
atggccttcaccgagagagtgaacagcagcggcaacagcctgtacaacgacgacagaaacctgctgagaatcagagagaaggagagaagaaaccaggaggcccaccaggagaaggaggccttccccgagaagatccccctgttcggcgagccctacaagaccgccaagggcgacgagctgagcagcagaatccagaacatgctgggcaactacgaggaggtgaaggagttcctgagcaccaagagccacacccacagactggacgccagcgagaacagactgggcaagcccaagtaccccctgatccccgacaagggcagcagcatccccagcagcagcttccacaccagcgtgcaccaccagagcatccacacccccgccagcggccccctgagcgtgggcaacatcagccacaaccccaagatggcccagcccagaaccgagcccatgcccagcctgcacgccaagagctgcggcccccccgacagccagcacctgacccaggacagactgggccaggagggcttcggcagcagccaccacaagaagggcgacagaagagccgacggcgaccactgcgccagcgtgaccgacagcgcccccgagagagagctgagccccctgatcagcctgcccagccccgtgccccccctgagccccatccacagcaaccagcagaccctgcccagaacccagggcagcagcaaggtgcacggcagcagcaacaacagcaagggctactgccccgccaagagccccaaggacctggccgtgaaggtgcacgacaaggagaccccccaggacagcctggtggcccccgcccagccccccagccagaccttccccccccccagcctgcccagcaagagcgtggccatgcagcagaagcccaccgcctacgtgagacccatggacggccaggaccaggcccccagcgagagccccgagctgaagcccctgcccgaggactacagacagcagaccttcgagaagaccgacctgaaggtgcccgccaaggccaagctgaccaagctgaagatgcccagccagagcgtggagcagacctacagcaacgaggtgcactgcgtggaggagatcctgaaggacagccagcacgtgagcagcgtgacccagaaccagaagcagtacgacaccagcagcaagacccacagcaacagccagcagggcaccagcagcatgctggaggacgacctgcagctgagcgacagcgaggacagcgacagcgagcagacccccgccccctag

SEQ ID NO: 9308 - DNA, 3657 bp, Artificial Sequence
  Description of Artificial Sequence: Synthetic coding sequence
atggccttcaccgagagagtgaacagcagcggcaacagcctgtacaacgacgacagaaacctgctgagaatcagagagaaggagagaagaaaccaggaggcccaccaggagaaggaggccttccccgagaagatccccctgttcggcgagccctacaagaccgccaagggcgacgagctgagcagcagaatccagaacatgctgggcaactacgaggaggtgaaggagttcctgagcaccaagagccacacccacagactggacgccagcgagaacagactgggcaagcccaagtaccccctgatccccgacaagggcagcagcatccccagcagcagcttccacaccagcgtgcaccaccagagcatccacacccccgccagcggccccctgagcgtgggcaacatcagccacaaccccaagatggcccagcccagaaccgagcccatgcccagcctgcacgccaagagctgcggcccccccgacagccagcacctgacccaggacagactgggccaggagggcttcggcagcagccaccacaagaagggcgacagaagagccgacggcgaccactgcgccagcgtgaccgacagcgcccccgagagagagctgagccccctgatcagcctgcccagccccgtgccccccctgagccccatccacagcaaccagcagaccctgcccagaacccagggcagcagcaaggtgcacggcagcagcaacaacagcaagggctactgccccgccaagagccccaaggacctggccgtgaaggtgcacgacaaggagaccccccaggacagcctggtggcccccgcccagccccccagccagaccttccccccccccagcctgcccagcaagagcgtggccatgcagcagaagcccaccgcctacgtgagacccatggacggccaggaccaggcccccagcgagagccccgagctgaagcccctgcccgaggactacagacagcagaccttcgagaagaccgacctgaaggtgcccgccaaggccaagctgaccaagctgaagatgcccagccagagcgtggagcagacctacagcaacgaggtgcactgcgtggaggagatcctgaaggagatgacccacagctggcccccccccctgaccgccatccacacccccagcaccgccgagcccagcaagttccccttccccaccaaggacagccagcacgtgagcagcgtgacccagaaccagaagcagtacgacaccagcagcaagacccacagcaacagccagcagggcaccagcagcatgctggaggacgacctgcagctgagcgacagcgaggacagcgacagcgagcagacccccgagaagccccccagcagcagcgccccccccagcgccccccagagcctgcccgagcccgtggccagcgcccacagcagcagcgccgagagcgagagcaccagcgacagcgacagcagcagcgacagcgagagcgagagcagcagcagcgacagcgaggagaacgagcccctggagacccccgcccccgagcccgagccccccaccaccaacaagtggcagctggacaactggctgaccaaggtgagccagcccgccgccccccccgagggccccagaagcaccgagccccccagaagacaccccgagagcaagggcagcagcgacagcgccaccagccaggagcacagcgagagcaaggaccccccccccaagagcagcagcaaggcccccagagccccccccgaggccccccaccccggcaagagaagctgccagaagagccccgcccagcaggagcccccccagagacagaccgtgggcaccaagcagcccaagaagcccgtgaaggccagcgccagagccggcagcagaaccagcctgcagggcgagagagagcccggcctgctgccctacggcagcagagaccagaccagcaaggacaagcccaaggtgaagaccaagggcagacccagagccgccgccagcaacgagcccaagcccgccgtgccccccagcagcgagaagaagaagcacaagagcagcctgcccgcccccagcaaggccctgagcggccccgagcccgccaaggacaacgtggaggacagaacccccgagcacttcgccctggtgcccctgaccgagagccagggccccccccacagcggcagcggcagcagaaccagcggctgcagacaggccgtggtggtgcaggaggacagcagaaaggacagactgcccctgcccctgagagacaccaagctgctgagccccctgagagacaccccccccccccagagcctgatggtgaagatcaccctggacctgctgagcagaatcccccagccccccggcaagggcagcagacagagaaaggccgaggacaagcagccccccgccggcaagaagcacagcagcgagaagagaagcagcgacagcagcagcaagctggccaagaagagaaagggcgaggccgagagagactgcgacaacaagaagatcagactggagaaggagatcaagagccagagcagcagcagcagcagcagccacaaggagagcagcaagaccaagcccagcagacccagcagccagagcagcaagaaggagatgctgccccccccccccgtgagcagcagcagccagaagcccgccaagcccgccctgaagagaagcagaagagaggccgacacctgcggccaggacccccccaagagcgccagcagcaccaagagcaaccacaaggacagcagcatccccaagcagagaagagtggagggcaagggcagcagaagcagcagcgagcacaagggcagcagcggcgacaccgccaaccccttccccgtgcccagcctgcccaacggcaacagcaagcccggcaagccccaggtgaagttcgacaagcagcaggccgacctgcacatgagagaggccaagaagatgaagcagaaggccgagctgatgaccgacagagtgggcaaggccttcaagtacctggaggccgtgctgagcttcatcgagtgcggcatcgccaccgagagcgagagccagagcagcaagagcgcctacagcgtgtacagcgagaccgtggacctgatcaagttcatcatgagcctgaagagcttcagcgacgccaccgcccccacccaggagaagatcttcgccgtgctgtgcatgagatgccagagcatcctgaacatggccatgttcagatgcaagaaggacatcgccatcaagtacagcagaaccctgaacaagcacttcgagagcagcagcaaggtggcccaggcccccagcccctgcatcgccagaagcaccggcacccccagccccctgagccccatgcccagccccgccagcagcgtgggcagccagagcagcgccggcagcgtgggcagcagcggcgtggccgccaccatcagcacccccgtgaccatccagaacatgaccagcagctacgtgaccatcaccagccacgtgctgaccgccttcgacctgtgggagcaggccgaggccctgaccagaaagaacaaggagttcttcgccagactgagcaccaacgtgtgcaccctggccctgaacagcagcctggtggacctggtgcactacaccagacagggcttccagcagctgcaggagctgaccaagaccccctag

SEQ ID NO: 9309 - DNA, 1221 bp, Artificial Sequence
  Description of Artificial Sequence: Synthetic coding sequence
atggccttcaccgagagagtgaacagcagcggcaacagcctgtacaacgacgacagaaacctgctgagaatcagagagaaggagagaagaaaccaggaggcccaccaggagaaggaggccttccccgagaagatccccctgttcggcgagccctacaagaccgccaagggcgacgagctgagcagcagaatccagaacatgctgggcaactacgaggaggtgaaggagttcctgagcaccaagagccacacccacagactggacgccagcgagaacagactgggcaagcccaagtaccccctgatccccgacaagggcagcagcatccccagcagcagcttccacaccagcgtgcaccaccagagcatccacacccccgccagcggccccctgagcgtgggcaacatcagccacaaccccaagatggcccagcccagaaccgagcccatgcccagcctgcacgccaagagctgcggcccccccgacagccagcacctgacccaggacagactgggccaggagggcttcggcagcagccaccacaagaagggcgacagaagagccgacggcgaccactgcgccagcgtgaccgacagcgcccccgagagagagctgagccccctgatcagcctgcccagccccgtgccccccctgagccccatccacagcaaccagcagaccctgcccagaacccagggcagcagcaaggtgcacggcagcagcaacaacagcaagggctactgccccgccaagagccccaaggacctggccgtgaaggtgcacgacaaggagaccccccaggacagcctggtggcccccgcccagccccccagccagaccttccccccccccagcctgcccagcaagagcgtggccatgcagcagaagcccaccgcctacgtgagacccatggacggccaggaccaggcccccagcgagagccccgagctgaagcccctgcccgaggactacagacagcagaccttcgagaagaccgacctgaaggtgcccgccaaggccaagctgaccaagctgaagatgcccagccagagcgtggagacctacagcaacgaggtgcactgcgtggaggagatcctgaaggagatgacccacagctggcccccccccctgaccgccatccacacccccagcaccgccgagcccagcaagttccccttccccaccaaggacagccagcacgtgagcagcgtgacccagtag

SEQ ID NO: 9310 - DNA, 1473 bp, Artificial Sequence
  Description of Artificial Sequence: Synthetic coding sequence
atgcccagccagagcgtggagcagacctacagcaacgaggtgcactgcgtggaggagatcctgaaggagatgacccacagctggcccccccccctgaccgccatccacacccccagcaccgccgagcccagcaagttccccttccccaccaaggacagccagcacgtgagcagcgtgacccagaaccagaagcagtacgacaccagcagcaagacccacagcaacagccagcagggcaccagcagcatgctggaggacgacctgcagctgagcgacagcgaggacagcgacagcgagcagacccccgagaagcccccccacctgcacctgcaggtgctgcacagccccttccagaaccagtggcaccagcacatccccgccgtgcagagccagaaggcccccgtgacccagaccgtgccccagacccagagagccagagccgtgcaggacagcgaggagaacgagcccctggagacccccgcccccgagcccgagccccccaccaccaacaagtggcagctggacaactggctgaccaaggtgagccagcccgccgccccccccgagggccccagaagcaccgagccccccagaagacaccccgagagcaagggcagcagcgacagcgccaccagccaggagcacagcgagagcaaggaccccccccccaagagcagcagcaaggcccccagagccccccccgaggccccccaccccggcaagagaagctgccagaagagccccgcccagcaggagcccccccagagacagaccgtgggcaccaagcagcccaagaagcccgtgaaggccagcgccagagccggcagcagaaccagcctgcagggcgagagagagcccggcctgctgccctacggcagcagagaccagaccagcaaggacaagcccaaggtgaagaccaagggcagacccagagccgccgccagcaacgagcccaagcccgccgtgccccccagcagcgagaagaagaagcacaagagcagcctgcccgcccccagcaaggccctgagcggccccgagcccgccaaggacaacgtggaggacagaacccccgagcacttcgccctggtgcccctgaccgagagccagggccccccccacagcggcagcggcagcagaaccagcggctgcagacaggccgtggtggtgcaggaggacagcagaaaggacagactgcccctgcccctgagagacaccaagctgctgagccccctgagagacaccccccccccccagagcctgatggtgaagatcaccctggacctgctgagcagaatcccccagccccccggcaagggcagcagacagagaaaggccgaggacaagcagccccccgccggcaagaagcacagcagcgagaagagaagcagcgacagcagcagcaagctggccaagaagagaaagggcgaggccgagagagactgcgacaacaagaagatcagactggagaagtag

SEQ ID NO: 9311 - DNA, 2550 bp, Artificial Sequence
  Description of Artificial Sequence: Synthetic coding sequence
atgacccacagctggcccccccccctgaccgccatccacacccccagcaccgccgagcccagcaagttccccttccccaccaaggacagccagcacgtgagcagcgtgacccagaaccagaagcagtacgacaccagcagcaagacccacagcaacagccagcagggcaccagcagcatgctggaggacgacctgcagctgagcgacagcgaggacagcgacagcgagcagacccccgagaagccccccagcagcagcgccccccccagcgccccccagagcctgcccgagcccgtggccagcgcccacagcagcagcgccgagagcgagagcaccagcgacagcgacagcagcagcgacagcgagagcgagagcagcagcagcgacagcgaggagaacgagcccctggagacccccgcccccgagcccgagccccccaccaccaacaagtggcagctggacaactggctgaccaaggtgagccagcccgccgccccccccgagggccccagaagcaccgagccccccagaagacaccccgagagcaagggcagcagcgacagcgccaccagccaggagcacagcgagagcaaggaccccccccccaagagcagcagcaaggcccccagagccccccccgaggccccccaccccggcaagagaagctgccagaagagccccgcccagcaggagcccccccagagacagaccgtgggcaccaagcagcccaagaagcccgtgaaggccagcgccagagccggcagcagaaccagcctgcagggcgagagagagcccggcctgctgccctacggcagcagagaccagaccagcaaggacaagcccaaggtgaagaccaagggcagacccagagccgccgccagcaacgagcccaagcccgccgtgccccccagcagcgagaagaagaagcacaagagcagcctgcccgcccccagcaaggccctgagcggccccgagcccgccaaggacaacgtggaggacagaacccccgagcacttcgccctggtgcccctgaccgagagccagggccccccccacagcggcagcggcagcagaaccagcggctgcagacaggccgtggtggtgcaggaggacagcagaaaggacagactgcccctgcccctgagagacaccaagctgctgagccccctgagagacaccccccccccccagagcctgatggtgaagatcaccctggacctgctgagcagaatcccccagccccccggcaagggcagcagacagagaaaggccgaggacaagcagccccccgccggcaagaagcacagcagcgagaagagaagcagcgacagcagcagcaagctggccaagaagagaaagggcgaggccgagagagactgcgacaacaagaagatcagactggagaaggagatcaagagccagagcagcagcagcagcagcagccacaaggagagcagcaagaccaagcccagcagacccagcagccagagcagcaagaaggagatgctgccccccccccccgtgagcagcagcagccagaagcccgccaagcccgccctgaagagaagcagaagagaggccgacacctgcggccaggacccccccaagagcgccagcagcaccaagagcaaccacaaggacagcagcatccccaagcagagaagagtggagggcaagggcagcagaagcagcagcgagcacaagggcagcagcggcgacaccgccaaccccttccccgtgcccagcctgcccaacggcaacagcaagcccggcaagccccaggtgaagttcgacaagcagcaggccgacctgcacatgagagaggccaagaagatgaagcagaaggccgagctgatgaccgacagagtgggcaaggccttcaagtacctggaggccgtgctgagcttcatcgagtgcggcatcgccaccgagagcgagagccagagcagcaagagcgcctacagcgtgtacagcgagaccgtggacctgatcaagttcatcatgagcctgaagagcttcagcgacgccaccgcccccacccaggagaagatcttcgccgtgctgtgcatgagatgccagagcatcctgaacatggccatgttcagatgcaagaaggacatcgccatcaagtacagcagaaccctgaacaagcacttcgagagcagcagcaaggtggcccaggcccccagcccctgcatcgccagaagcaccggcacccccagccccctgagccccatgcccagccccgccagcagcgtgggcagccagagcagcgccggcagcgtgggcagcagcggcgtggccgccaccatcagcacccccgtgaccatccagaacatgaccagcagctacgtgaccatcaccagccacgtgctgaccgccttcgacctgtgggagcaggccgaggccctgaccagaaagaacaaggagttcttcgccagactgagcaccaacgtgtgcaccctggccctgaacagcagcctggtggacctggtgcactacaccagacagggcttccagcagctgcaggagctgaccaagaccccctag

SEQ ID NO: 9312 - DNA, 2376 bp, Artificial Sequence
  Description of Artificial Sequence: Synthetic coding sequence
atgcccgacatgcacttcaaggcccccaagatcagcatgcccgacgtggacctgcacctgaagggccccaaggtgaagggcgacgtggacgtgagcgtgcccaagctggagggcgacctgaccggccccagcgtgggcgtggaggtgcccgacgtggagctggagtgccccgacgccaagctgaagggccccaagttcaagatgcccgagatgcacttcaagacccccaagatcagcatgcccgacgtggacctgcacctgaagggccccaaggtgaagggcgacatggacgtgagcgtgcccaaggtggagggcgagatgaaggtgcccgacgtggacatcaagggccccaagatggacatcgacgcccccgacgtggacgtgcacggccccgactggcacctgaagatgcccaagatgaagatgcccaagttcagcatgcccggcttcaaggccgagggccccgaggtggacgtgaacctgcccaaggccgacgtggtggtgagcggccccaaggtggacgtggaggtgcccgacgtgagcctggagggccccgagggcaagctgaagggccccaagctgaagatgcccgagatgcacttcaaggcccccaagatcagcatgcccgacgtggacctgcacctgaagggccccaaggtgaagggcgacgtggacgtgagcctgcccaagctggagggcgacctgaccggccccagcgtggacgtggaggtgcccgacgtggagctggagtgccccgacgccaagctgaagggccccaagttcaagatgcccgagatgcacttcaagacccccaagatcagcatgcccgacgtgaacctgaacctgaagggccccaaggtgaagggcgacatggacgtgagcgtgcccaaggtggagggcgagatgaaggtgcccgacgtggacatcagaggccccaaggtggacatcgacgcccccgacgtggacgtgcacggccccgactggcacctgaagatgcccaagatgaagatgcccaagttcagcatgcccggcttcaagggcgagggccccgaggtggacgtgaacctgcccaaggccgacgtggacgtgagcggccccaaggtggacgtggaggtgcccgacgtgagcctggagggccccgagggcaagctgaagggccccaagttcaagatgcccgagatgcacttcaagacccccaagatcagcatgcccgacgtggacttcaacctgaagggccccaagatcaagggcgacgtggacgtgagcgcccccaagctggagggcgagctgaagggccccgagctggacgtgaagggccccaagctggacgccgacatgcccgaggtggccgtggagggccccaacggcaagtggaagacccccaagttcaagatgcccgacatgcacttcaaggcccccaagatcagcatgcccgacctggacctgcacctgaagagccccaaggccaagggcgaggtggacgtggacgtgcccaagctggagggcgacctgaagggcccccacgtggacgtgagcggccccgacatcgacatcgagggccccgagggcaagctgaagggccccaagttcaagatgcccgacatgcacttcaaggcccccaacatcagcatgcccgacgtggacctgaacctgaagggccccaagatcaagggcgacgtggacgtgagcgtgcccgaggtggagggcaagctggaggtgcccgacatgaacatcagaggccccaaggtggacgtgaacgcccccgacgtgcaggcccccgactggcacctgaagatgcccaagatgaagatgcccaagttcagcatgcccggcttcaaggccgagggccccgaggtggacgtgaacctgcccaaggccgacgtggacatcagcggccccaaggtggacatcgagggccccgacgtgaacatcgagggccccgagggcaagctgaagggccccaagctgaagatgcccgagatgaacatcaaggcccccaagatcagcatgcccgacttcgacctgcacctgaagggccccaaggtgaagggcgacgtggacgtgagcctgcccaaggtggagggcgacctgaagggccccgaggtggacatcaagggccccaaggtggacatcaacgcccccgacgtgggcgtgcagggccccgactggcacctgaagatgcccaaggtgaagatgcccaagttcagcatgcccggcttcaagggcgagggccccgacggcgacgtgaagctgcccaaggccgacatcgacgtgagcggccccaaggtggacatcgagggccccgacgtgaacatcgagggccccgagggcaagctgaagggccccaagttcaagatggcccagagatggtggtag

SEQ ID NO: 9313 - DNA, 450 bp, Artificial Sequence
  Description of Artificial Sequence: Synthetic coding sequence
atggagaaggaggagaccaccagagagctgctgctgcccaactggcagggcagcggcagccacggcctgaccatcgcccagagagacgacggcgtgttcgtgcaggaggtgacccagaacagccccgccgccagaaccggcgtggtgaaggagggcgaccagatcgtgggcgccaccatctacttcgacaacctgcagagcggcgaggtgacccagctgctgaacaccatgggccaccacaccgtgggcctgaagctgcacagaaagggcgacagaagccccgagcccggccagacctggaccagagaggtgttcagcagctgcagcagcgaggtggtgctgaacaccccccagcccagcgccctggagtgcaaggaccagaacaagcagaaggaggccagcagccaggccggcgccgtgagcgtgagcacccccaacgccggcctgtag

SEQ ID NO: 9314 - DNA, 17673 bp, Artificial Sequence
  Description of Artificial Sequence: Synthetic coding sequence
atggagaaggaggagaccaccagagagctgctgctgcccaactggcagggcagcggcagccacggcctgaccatcgcccagagagacgacggcgtgttcgtgcaggaggtgacccagaacagccccgccgccagaaccggcgtggtgaaggagggcgaccagatcgtgggcgccaccatctacttcgacaacctgcagagcggcgaggtgacccagctgctgaacaccatgggccaccacaccgtgggcctgaagctgcacagaaagggcgacagaagccccgagcccggccagacctggaccagagaggtgttcagcagctgcagcagcgaggtggtgctgagcggcgacgacgaggagtaccagagaatctacaccaccaagatcaagcccagactgaagagcgaggacggcgtggagggcgacctgggcgagacccagagcagaaccatcaccgtgaccagaagagtgaccgcctacaccgtggacgtgaccggcagagagggcgccaaggacatcgacatcagcagccccgagttcaagatcaagatccccagacacgagctgaccgagatcagcaacgtggacgtggagacccagagcggcaagaccgtgatcagactgcccagcggcagcggcgccgccagccccaccggcagcgccgtggacatcagagccggcgccatcagcgccagcggccccgagctgcagggcgccggccacagcaagctgcaggtgaccatgcccggcatcaaggtgggcggcagcggcgtgaacgtgaacgccaagggcctggacctgggcggcagaggcggcgtgcaggtgcccgccgtggacatcagcagcagcctgggcggcagagccgtggaggtgcagggccccagcctggagagcggcgaccacggcaagatcaagttccccaccatgaaggtgcccaagttcggcgtgagcaccggcagagagggccagacccccaaggccggcctgagagtgagcgcccccgaggtgagcgtgggccacaagggcggcaagcccggcctgaccatccaggccccccagctggaggtgagcgtgcccagcgccaacatcgagggcctggagggcaagctgaagggcccccagatcaccggccccagcctggagggcgacctgggcctgaagggcgccaagccccagggccacatcggcgtggacgccagcgccccccagatcggcggcagcatcaccggccccagcgtggaggtgcaggcccccgacatcgacgtgcagggccccggcagcaagctgaacgtgcccaagatgaaggtgcccaagttcagcgtgagcggcgccaagggcgaggagaccggcatcgacgtgaccctgcccaccggcgaggtgaccgtgcccggcgtgagcggcgacgtgagcctgcccgagatcgccaccggcggcctggagggcaagatgaagggcaccaaggtgaagacccccgagatgatcatccagaagcccaagatcagcatgcaggacgtggacctgagcctgggcagccccaagctgaagggcgacatcaaggtgagcgcccccggcgtgcagggcgacgtgaagggcccccaggtggccctgaagggcagcagagtggacatcgagacccccaacctggagggcaccctgaccggccccagactgggcagccccagcggcaagaccggcacctgcagaatcagcatgagcgaggtggacctgaacgtggccgcccccaaggtgaagggcggcgtggacgtgaccctgcccagagtggagggcaaggtgaaggtgcccgaggtggacgtgagaggccccaaggtggacgtgagcgcccccgacgtggaggcccacggccccgagtggaacctgaagatgcccaagatgaagatgcccaccttcagcacccccggcgccaagggcgagggccccgacgtgcacatgaccctgcccaagggcgacatcagcatcagcggccccaaggtgaacgtggaggcccccgacgtgaacctggagggcctgggcggcaagctgaagggccccgacgtgaagctgcccgacatgagcgtgaagacccccaagatcagcatgcccgacgtggacctgcacgtgaagggcaccaaggtgaagggcgagtacgacgtgaccgtgcccaagctggagggcgagctgaagggccccaaggtggacatcgacgcccccgacgtggacgtgcacggccccgactggcacctgaagatgcccaagatgaagatgcccaagttcagcgtgcccggcttcaaggccgagggccccgaggtggacgtgaacctgcccaaggccgacgtggacatcagcggccccaagatcgacgtgaccgcccccgacgtgagcatcgaggagcccgagggcaagctgaagggccccaagttcaagatgcccgagatgaacatcaaggtgcccaagatcagcatgcccgacgtggacctgcacctgaagggccccaacgtgaagggcgagtacgacgtgaccatgcccaaggtggagagcgagatcaaggtgcccgacgtggagctgaagagcgccaagatggacatcgacgtgcccgacgtggaggtgcagggccccgactggcacctgaagatgcccaagatgaagatgcccaagttcagcatgcccggcttcaaggccgagggccccgaggtggacgtgaacctgcccaaggccgacgtggacatcagcggccccaaggtgggcgtggaggtgcccgacgtgaacatcgagggccccgagggcaagctgaagggccccaagttcaagatgcccgagatgaacatcaaggcccccaagatcagcatgcccgacgtggacctgcacatgaagggccccaaggtgaagggcgagtacgacatgaccgtgcccaagctggagggcgacctgaagggccccaaggtggacgtgagcgcccccgacgtggagatgcagggccccgactggaacctgaagatgcccaagatcaagatgcccaagttcagcatgcccagcctgaagggcgagggccccgagttcgacgtgaacctgagcaaggccaacgtggacatcagcgcccccaaggtggacaccaacgcccccgacctgagcctggagggccccgagggcaagctgaagggccccaagttcaagatgcccgagatgcacttcagagcccccaagatgagcctgcccgacgtggacctggacctgaagggccccaagatgaagggcaacgtggacatcagcgcccccaagatcgagggcgagatgcaggtgcccgacgtggacatcagaggccccaaggtggacatcaaggcccccgacgtggagggccagggcctggactggagcctgaagatccccaagatgaagatgcccaagttcagcatgcccagcctgaagggcgagggccccgaggtggacgtgaacctgcccaaggccgacgtggtggtgagcggccccaaggtggacatcgaggcccccgacgtgagcctggagggccccgagggcaagctgaagggccccaagttcaagatgcccgagatgcacttcaagacccccaagatcagcatgcccgacgtggacctgcacctgaagggccccaaggtgaagggcgacgtggacgtgagcgtgcccaaggtggagggcgagatgaaggtgcccgacgtggagatcaagggccccaagatggacatcgacgcccccgacgtggaggtgcagggccccgactggcacctgaagatgcccaagatgaagatgcccaagttcagcatgcccggcttcaagggcgagggcagagaggtggacgtgaacctgcccaaggccgacatcgacgtgagcggccccaaggtggacgtggaggtgcccgacgtgagcctggagggccccgagggcaagctgaagggccccaagttcaagatgcccgagatgcacttcaaggcccccaagatcagcatgcccgacgtggacctgaacctgaagggccccaagctgaagggcgacgtggacgtgagcctgcccgaggtggagggcgagatgaaggtgcccgacgtggacatcaagggccccaaggtggacatcagcgcccccgacgtggacgtgcacggccccgactggcacctgaagatgcccaaggtgaagatgcccaagttcagcatgcccggcttcaagggcgagggccccgaggtggacgtgaagctgcccaaggccgacgtggacgtgagcggccccaagatggacgccgaggtgcccgacgtgaacatcgagggccccgacgccaagctgaagggccccaagttcaagatgcccgagatgagcatcaagccccagaagatcagcatccccgacgtgggcctgcacctgaagggccccaagatgaagggcgactacgacgtgaccgtgcccaaggtggagggcgagatcaaggcccccgacgtggacatcaagggccccaaggtggacatcaacgcccccgacgtggaggtgcacggccccgactggcacctgaagatgcccaaggtgaagatgcccaagttcagcatgcccggcttcaagggcgagggccccgaggtggacatgaacctgcccaaggccgacctgggcgtgagcggccccaaggtggacatcgacgtgcccgacgtgaacctggaggcccccgagggcaagctgaagggccccaagttcaagatgcccagcatgaacatccagacccacaagatcagcatgcccgacgtgggcctgaacctgaaggcccccaagctgaagaccgacgtggacgtgagcctgcccaaggtggagggcgacctgaagggccccgagatcgacgtgaaggcccccaagatggacgtgaacgtgggcgacatcgacatcgagggccccgagggcaagctgaagggccccaagttcaagatgcccgagatgcacttcaaggcccccaagatcagcatgcccgacgtggacctgcacctgaagggccccaaggtgaagggcgacatggacgtgagcgtgcccaaggtggagggcgagatgaaggtgcccgacgtggacatcaagggccccaaggtggacatcgacgcccccgacgtggaggtgcacgaccccgactggcacctgaagatgcccaagatgaagatgcccaagttcagcatgcccggcttcaaggccgagggccccgaggtggacgtgaacctgcccaaggccgacatcgacgtgagcggccccagcgtggacaccgacgcccccgacctggacatcgagggccccgagggcaagctgaagggcagcaagttcaagatgcccaagctgaacatcaaggcccccaaggtgagcatgcccgacgtggacctgaacctgaagggccccaagctgaagggcgagatcgacgccagcgtgcccgagctggagggcgacctgagaggcccccaggtggacgtgaagggccccttcgtggaggccgaggtgcccgacgtggacctggagtgccccgacgccaagctgaagggccccaagttcaagatgcccgagatgcacttcaaggcccccaagatcagcatgcccgacgtggacctgcacctgaagggccccaaggtgaagggcgacgccgacgtgagcgtgcccaagctggagggcgacctgaccggccccagcgtgggcgtggaggtgcccgacgtggagctggagtgccccgacgccaagctgaagggccccaagttcaagatgcccgacatgcacttcaaggcccccaagatcagcatgcccgacgtggacctgcacctgaagggccccaaggtgaagggcgacgtggacgtgagcgtgcccaagctggagggcgacctgaccggccccagcgtgggcgtggaggtgcccgacgtggagctggagtgccccgacgccaagctgaagggccccaagttcaagatgcccgagatgcacttcaagacccccaagatcagcatgcccgacgtggacctgcacctgaagggccccaaggtgaagggcgacatggacgtgagcgtgcccaaggtggagggcgagatgaaggtgcccgacgtggacatcaagggccccaagatggacatcgacgcccccgacgtggacgtgcacggccccgactggcacctgaagatgcccaagatgaagatgcccaagttcagcatgcccggcttcaaggccgagggccccgaggtggacgtgaacctgcccaaggccgacgtggtggtgagcggccccaaggtggacgtggaggtgcccgacgtgagcctggagggccccgagggcaagctgaagggccccaagctgaagatgcccgagatgcacttcaaggcccccaagatcagcatgcccgacgtggacctgcacctgaagggccccaaggtgaagggcgacgtggacgtgagcctgcccaagctggagggcgacctgaccggccccagcgtggacgtggaggtgcccgacgtggagctggagtgccccgacgccaagctgaagggccccaagttcaagatgcccgagatgcacttcaagacccccaagatcagcatgcccgacgtgaacctgaacctgaagggccccaaggtgaagggcgacatggacgtgagcgtgcccaaggtggagggcgagatgaaggtgcccgacgtggacatcagaggccccaaggtggacatcgacgcccccgacgtggacgtgcacggccccgactggcacctgaagatgcccaagatgaagatgcccaagttcagcatgcccggcttcaagggcgagggccccgaggtggacgtgaacctgcccaaggccgacgtggacgtgagcggccccaaggtggacgtggaggtgcccgacgtgagcctggagggccccgagggcaagctgaagggccccaagttcaagatgcccgagatgcacttcaagacccccaagatcagcatgcccgacgtggacttcaacctgaagggccccaagatcaagggcgacgtggacgtgagcgcccccaagctggagggcgagctgaagggccccgagctggacgtgaagggccccaagctggacgccgacatgcccgaggtggccgtggagggccccaacggcaagtggaagacccccaagttcaagatgcccgacatgcacttcaaggcccccaagatcagcatgcccgacctggacctgcacctgaagagccccaaggccaagggcgaggtggacgtggacgtgcccaagctggagggcgacctgaagggcccccacgtggacgtgagcggccccgacatcgacatcgagggccccgagggcaagctgaagggccccaagttcaagatgcccgacatgcacttcaaggcccccaacatcagcatgcccgacgtggacctgaacctgaagggccccaagatcaagggcgacgtggacgtgagcgtgcccgaggtggagggcaagctggaggtgcccgacatgaacatcagaggccccaaggtggacgtgaacgcccccgacgtgcaggcccccgactggcacctgaagatgcccaagatgaagatgcccaagttcagcatgcccggcttcaaggccgagggccccgaggtggacgtgaacctgcccaaggccgacgtggacatcagcggccccaaggtggacatcgagggccccgacgtgaacatcgagggccccgagggcaagctgaagggccccaagctgaagatgcccgagatgaacatcaaggcccccaagatcagcatgcccgacttcgacctgcacctgaagggccccaaggtgaagggcgacgtggacgtgagcctgcccaaggtggagggcgacctgaagggccccgaggtggacatcaagggccccaaggtggacatcaacgcccccgacgtgggcgtgcagggccccgactggcacctgaagatgcccaaggtgaagatgcccaagttcagcatgcccggcttcaagggcgagggccccgacggcgacgtgaagctgcccaaggccgacatcgacgtgagcggccccaaggtggacatcgagggccccgacgtgaacatcgagggccccgagggcaagctgaagggccccaagttcaagatgcccgagatgaacatcaaggcccccaagatcagcatgcccgacatcgacctgaacctgaagggccccaaggtgaagggcgacgtggacgtgagcctgcccaaggtggagggcgacctgaagggccccgaggtggacatcaagggccccaaggtggacatcgacgcccccgacgtggacgtgcacggccccgactggcacctgaagatgcccaagatcaagatgcccaagatcagcatgcccggcttcaagggcgagggccccgacgtggacgtgaacctgcccaaggccgacatcgacgtgagcggccccaaggtggacgtggagtgccccgacgtgaacatcgagggccccgagggcaagtggaagagccccaagttcaagatgcccgagatgcacttcaagacccccaagatcagcatgcccgacatcgacctgaacctgaccggccccaagatcaagggcgacgtggacgtgaccggccccaaggtggagggcgacctgaagggccccgaggtggacctgaagggccccaaggtggacatcgacgtgcccgacgtgaacgtgcagggccccgactggcacctgaagatgcccaagatgaagatgcccaagttcagcatgcccggcttcaaggccgagggccccgaggtggacgtgaacctgcccaaggccgacgtggacgtgagcggccccaaggtggacgtggagggccccgacgtgaacatcgagggccccgagggcaagctgaagggccccaagttcaagatgcccgagatgaacatcaaggcccccaagatccccatgcccgacttcgacctgcacctgaagggccccaaggtgaagggcgacgtggacatcagcctgcccaaggtggagggcgacctgaagggccccgaggtggacatcagaggcccccaggtggacatcgacgtgcccgacgtgggcgtgcagggccccgactggcacctgaagatgcccaaggtgaagatgcccaagttcagcatgcccggcttcaagggcgagggccccgacgtggacgtgaacctgcccaaggccgacctggacgtgagcggccccaaggtggacatcgacgtgcccgacgtgaacatcgagggccccgagggcaagctgaagggccccaagttcaagatgcccgagatgaacatcaaggcccccaagatcagcatgcccgacatcgacctgaacctgaagggccccaaggtgaagggcgacatggacgtgagcctgcccaaggtggagggcgacatgaaggtgcccgacgtggacatcaagggccccaaggtggacatcaacgcccccgacgtggacgtgcagggccccgactggcacctgaagatgcccaagatcaagatgcccaagatcagcatgcccggcttcaagggcgagggccccgaggtggacgtgaacctgcccaaggccgacctggacgtgagcggccccaaggtggacgtggacgtgcccgacgtgaacatcgagggccccgacgccaagctgaagggccccaagttcaagatgcccgagatgaacatcaaggcccccaagatcagcatgcccgacctggacctgaacctgaagggccccaagatgaagggcgaggtggacgtgagcctggccaacgtggagggcgacctgaagggccccgccctggacatcaagggccccaagatcgacgtggacgcccccgacatcgacatccacggccccgacgccaagctgaagggccccaagctgaagatgcccgacatgcacgtgaacatgcccaagatcagcatgcccgagatcgacctgaacctgaagggcagcaagctgaagggcgacgtggacgtgagcggccccaagctggagggcgacatcaaggcccccagcctggacatcaagggccccgaggtggacgtgagcggccccaagctgaacatcgagggcaagagcaagaagagcagattcaagctgcccaagttcaacttcagcggcagcaaggtgcagacccccgaggtggacgtgaagggcaagaagcccgacatcgacatcaccggccccaaggtggacatcaacgcccccgacgtggaggtgcagggcaaggtgaagggcagcaagttcaagatgcccttcctgagcatcagcagccccaaggtgagcatgcccgacgtggagctgaacctgaagagccccaaggtgaagggcgacctggacatcgccggccccaacctggagggcgacttcaagggccccaaggtggacatcaaggcccccgaggtgaacctgaacgcccccgacgtggacgtgcacggccccgactggaacctgaagatgcccaagatgaagatgcccaagttcagcgtgagcggcctgaaggccgagggccccgacgtggccgtggacctgcccaagggcgacatcaacatcgagggccccagcatgaacatcgagggccccgacctgaacgtggagggccccgagggcggcctgaagggccccaagttcaagatgcccgacatgaacatcaaggcccccaagatcagcatgcccgacatcgacctgaacctgaagggccccaaggtgaagggcgacgtggacatcagcctgcccaagctggagggcgacctgaagggccccgaggtggacatcaagggccccaaggtggacatcaacgcccccgacgtggacgtgcacggccccgactggcacctgaagatgcccaaggtgaagatgcccaagttcagcatgcccggcttcaagggcgagggccccgaggtggacgtgaccctgcccaaggccgacatcgacatcagcggccccaacgtggacgtggacgtgcccgacgtgaacatcgagggccccgacgccaagctgaagggccccaagttcaagatgcccgagatgaacatcaaggcccccaagatcagcatgcccgacttcgacctgaacctgaagggccccaagatgaagggcgacgtggtggtgagcctgcccaaggtggagggcgacctgaagggccccgaggtggacatcaagggccccaaggtggacatcgacacccccgacatcaacatcgagggcagcgagggcaagttcaagggccccaagttcaagatccccgagatgcacctgaaggcccccaagatcagcatgcccgacatcgacctgaacctgaagggccccaaggtgaagggcgacgtggacgtgagcctgcccaagatggagggcgacctgaagggccccgaggtggacatcaagggccccaaggtggacatcaacgcccccgacgtggacgtgcagggccccgactggcacctgaagatgcccaaggtgaagatgcccaagttcagcatgcccggcttcaagggcgagggccccgacgtggacgtgaacctgcccaaggccgacctggacgtgagcggccccaaggtggacatcgacgtgcccgacgtgaacatcgagggccccgagggcaagctgaagggccccaagttcaagatgcccgagatgaacatcaaggcccccaagatcagcatgcccgacatcgacctgaacctgaagggccccaaggtgaagggcgacatggacgtgagcctgcccaaggtggagggcgacatgcaggtgcccgacctggacatcaagggccccaaggtggacatcaacgcccccgacgtggacgtgagaggccccgactggcacctgaagatgcccaagatcaagatgcccaagatcagcatgcccggcttcaagggcgagggccccgaggtggacgtgaacctgcccaaggccgacctggacgtgagcggccccaaggtggacgtggacgtgcccgacgtgaacatcgagggccccgacgccaagctgaagggccccaagttcaagatgcccgagatgaacatcaaggcccccaagatcagcatgcccgacttcgacctgcacctgaagggccccaaggtgaagggcgacgtggacgtgagcctgcccaagatggagggcgacctgaaggcccccgaggtggacatcaagggccccaaggtggacatcgacgcccccgacgtggacgtgcacggccccgactggcacctgaagatgcccaaggtgaagatgcccaagttcagcatgcccggcttcaagggcgagggccccgaggtggacgtgaacctgcccaaggccgacatcgacgtgagcggccccaaggtggacatcgacacccccgacatcgacatccacggccccgagggcaagctgaagggccccaagttcaagatgcccgacctgcacctgaaggcccccaagatcagcatgcccgaggtggacctgaacctgaagggccccaagatgaagggcgacgtggacgtgagcctgcccaaggtggagggcgacctgaagggccccgaggtggacatcaagggccccaaggtggacatcgacgtgcccgacgtggacgtgcagggccccgactggcacctgaagatgcccaaggtgaagatgcccaagttcagcatgcccggcttcaagggcgagggccccgacgtggacgtgaacctgcccaaggccgacctggacgtgagcggccccaaggtggacatcgacgtgcccgacgtgaacatcgagggccccgacgccaagctgaagggccccaagttcaagatgcccgagatgaacatcaaggcccccaagatcagcatgcccgacttcgacctgcacctgaagggccccaaggtgaagggcgacgtggacgtgagcctgcccaaggtggagggcgacctgaagggccccgaggtggacatcaagggccccaaggtggacatcgacgcccccgacgtggacgtgcacggccccgactggcacctgaagatgcccaaggtgaagatgcccaagttcagcatgcccggcttcaagggcgagggccccgacgtggacgtgaccctgcccaaggccgacatcgagatcagcggccccaaggtggacatcgacgcccccgacgtgagcatcgagggccccgacgccaagctgaagggccccaagttcaagatgcccgagatgaacatcaaggcccccaagatcagcatgcccgacatcgacttcaacctgaagggccccaaggtgaagggcgacgtggacgtgagcctgcccaaggtggagggcgacctgaagggccccgagatcgacatcaagggccccagcctggacatcgacacccccgacgtgaacatcgagggccccgagggcaagctgaagggccccaagttcaagatgcccgagatgaacatcaaggcccccaagatcagcatgcccgacttcgacctgcacctgaagggccccaaggtgaagggcgacgtggacgtgagcctgcccaaggtggagagcgacctgaagggccccgaggtggacatcgagggccccgagggcaagctgaagggccccaagttcaagatgcccgacgtgcacttcaagagcccccagatcagcatgagcgacatcgacctgaacctgaagggccccaagatcaagggcgacatggacatcagcgtgcccaagctggagggcgacctgaagggccccaaggtggacgtgaagggccccaaggtgggcatcgacacccccgacatcgacatccacggccccgagggcaagctgaagggccccaagttcaagatgcccgacctgcacctgaaggcccccaagatcagcatgcccgaggtggacctgaacctgaagggccccaaggtgaagggcgacatggacatcagcctgcccaaggtggagggcgacctgaagggccccgaggtggacatcagagaccccaaggtggacatcgacgtgcccgacgtggacgtgcagggccccgactggcacctgaagatgcccaaggtgaagatgcccaagttcagcatgcccggcttcaagggcgagggccccgacgtggacgtgaacctgcccaaggccgacatcgacgtgagcggccccaaggtggacgtggacgtgcccgacgtgaacatcgagggccccgacgccaagctgaagggccccaagttcaagatgcccgagatgagcatcaaggcccccaagatcagcatgcccgacatcgacctgaacctgaagggccccaaggtgaagggcgacgtggacgtgaccctgcccaaggtggagggcgacctgaagggccccgaggccgacatcaagggccccaaggtggacatcaacacccccgacgtggacgtgcacggccccgactggcacctgaagatgcccaaggtgaagatgcccaagttcagcatgcccggcttcaagggcgagggccccgacgtggacgtgagcctgcccaaggccgacatcgacgtgagcggccccaaggtggacgtggacatccccgacgtgaacatcgagggccccgacgccaagctgaagggccccaagttcaagatgcccgagatcaacatcaaggcccccaagatcagcatccccgacgtggacctggacctgaagggccccaaggtgaagggcgacttcgacgtgagcgtgcccaaggtggagggcaccctgaagggccccgaggtggacctgaagggccccagactggacttcgagggccccgacgccaagctgagcggccccagcctgaagatgcccagcctggagatcagcgcccccaaggtgaccgcccccgacgtggacctgcacctgaaggcccccaagatcggcttcagcggccccaagctggagggcggcgaggtggacctgaagggccccaaggtggaggcccccagcctggacgtgcacatggacagccccgacatcaacatcgagggccccgacgtgaagatccccaagttcaagaagcccaagttcggcttcggcgccaagagccccaaggccgacatcaagagccccagcctggacgtgaccgtgcccgaggccgagctgaacctggagacccccgagatcagcgtgggcggcaagggcaagaagagcaagttcaagatgcccaagatccacatgagcggccccaagatcaaggccaagaagcagggcttcgacctgaacgtgcccggcggcgagatcgacgccagcctgaaggcccccgacgtggacgtgaacatcgccggccccgacgccgccctgaaggtggacgtgaagagccccaagaccaagaagaccatgttcggcaagatgtacttccccgacgtggagttcgacatcaagagccccaagttcaaggccgaggcccccctgcccagccccaagctggagggcgagctgcaggcccccgacctggagctgagcctgcccgccatccacgtggagggcctggacatcaaggccaaggcccccaaggtgaagatgcccgacgtggacatcagcgtgcccaagatcgagggcgacctgaagggccccaaggtgcaggccaacctgggcgcccccgacatcaacatcgagggcctggacgccaaggtgaagacccccagcttcggcatcagcgccccccaggtgagcatccccgacgtgaacgtgaacctgaagggccccaagatcaagggcgacgtgcccagcgtgggcctggagggccccgacgtggacctgcagggccccgaggccaagatcaagttccccaagttcagcatgcccaagatcggcatccccggcgtgaagatggagggcggcggcgccgaggtgcacgcccagctgcccagcctggagggcgacctgagaggccccgacgtgaagctggagggccccgacgtgagcctgaagggccccggcgtggacctgcccagcgtgaacctgagcatgcccaaggtgagcggccccgacctggacctgaacctgaagggccccagcctgaagggcgacctggacgccagcgtgcccagcatgaaggtgcacgcccccggcctgaacctgagcggcgtgggcggcaagatgcaggtgggcggcgacggcgtgaaggtgcccggcatcgacgccaccaccaagctgaacgtgggcgcccccgacgtgaccctgagaggccccagcctgcagggcgacctggccgtgagcggcgacatcaagtgccccaaggtgagcgtgggcgcccccgacctgagcctggaggccagcgagggcagcatcaagctgcccaagatgaagctgccccagttcggcatcagcacccccggcagcgacctgcacgtgaacgccaagggcccccaggtgagcggcgagctgaagggccccggcgtggacgtgaacctgaagggccccagaatcagcgcccccaacgtggacttcaacctggagggccccaaggtgaagggcagcctgggcgccaccggcgagatcaagggccccaccgtgggcggcggcctgcccggcatcggcgtgcagggcctggagggcaacctgcagatgcccggcatcaagagcagcggctgcgacgtgaacctgcccggcgtgaacgtgaagctgcccaccggccagatcagcggccccgagatcaagggcggcctgaagggcagcgaggtgggcttccacggcgccgcccccgacatcagcgtgaagggccccgccttcaacatggccagccccgagagcgacttcggcatcaacctgaagggccccaagatcaagggcggcgccgacgtgagcggcggcgtgagcgcccccgacatcagcctgggcgagggccacctgagcgtgaagggcagcggcggcgagtggaagggcccccaggtgagcagcgccctgaacctggacaccagcaagttcgccggcggcctgcacttcagcggccccaaggtggagggcggcgtgaagggcggccagatcggcctgcaggcccccggcctgagcgtgagcggcccccagggccacctggagagcggcagcggcaaggtgaccttccccaagatgaagatccccaagttcaccttcagcggcagagagctggtgggcagagagatgggcgtggacgtgcacttccccaaggccgaggccagcatccaggccggcgccggcgacggcgagtgggaggagagcgaggtgaagctgaagaagagcaagatcaagatgcccaagttcaacttcagcaagcccaagggcaagggcggcgtgaccggcagccccgaggccagcatcagcggcagcaagggcgacctgaagagcagcaaggccagcctgggcagcctggagggcgaggccgaggccgaggccagcagccccaagggcaagttcagcctgttcaagagcaagaagcccagacacagaagcaacagcttcagcgacgagagagagttcagcggccccagcacccccaccggcaccctggagttcgagggcggcgaggtgagcctggagggcggcaaggtgaagggcaagcacggcaagctgaagttcggcaccttcggcggcctgggcagcaagagcaagggccactacgaggtgaccggcagcgacgacgagaccggcaagctgcagggcagcggcgtgagcctggccagcaagaagagcagactgagcagcagcagcagcaacgacagcggcaacaaggtgggcatccagctgcccgaggtggagctgagcgtgagcaccaagaaggagtag

SEQ ID NO: 9315 - DNA, 372 bp, Artificial Sequence
  Description of Artificial Sequence: Synthetic coding sequence
atggagaaggaggagaccaccagagagctgctgctgcccaactggcagggcagcggcagccacggcctgaccatcgcccagagagacgacggcgtgttcgtgcaggaggtgacccagaacagccccgccgccagaaccggcgtggtgaaggagggcgaccagatcgtgggcgccaccatctacttcgacaacctgcagagcggcgaggtgacccagctgctgaacaccatgggccaccacaccgtgggcctgaagctgcacagaaagggcgacagaagccccgagcccggccagacctggaccagagaggtgttcagcagctgcagcagcgaggtggtgctgagcggcgacgacgaggagtaccagagatag

SEQ ID NO: 9316 - DNA, 435 bp, Artificial Sequence
  Description of Artificial Sequence: Synthetic coding sequence
atggagaaggaggagaccaccagagagctgctgctgcccaactggcagggcagcggcagccacggcctgaccatcgcccagagagacgacggcgtgttcgtgcaggaggtgacccagaacagccccgccgccagaaccggcgtggtgaaggagggcgaccagatcgtgggcgccaccatctacttcgacaacctgcagagcggcgaggtgacccagctgctgaacaccatgggccaccacaccgtgggcctgaagctgcacagaaagggcgacagaagccccgagcccggccagacctggaccagagaggtgttcagcagctgcagcagcgaggtggtgctgagcggcgacgacgaggagtaccagagaatctacaccaccaagatcaagcccagactgaagagcgaggacggcgtggagggcgacctgggctag

SEQ ID NO: 9317 - DNA, 261 bp, Artificial Sequence
  Description of Artificial Sequence: Synthetic coding sequence
atggagaaggaggagaccaccagagagctgctgctgcccaactggcagggcagcggcagccacggcctgaccatcgcccagagagacgacggcgtgttcgtgcaggaggtgacccagaacagccccgccgccagaaccggcgtggtgaaggagggcgaccagatcgtgggcgccaccatctacttcgacaacctgcagagcggcgaggtgacccagctgctgaacaccatgggccaccacaccgtgggcctgaagctgtag

SEQ ID NO: 9318 - DNA, 366 bp, Artificial Sequence
  Description of Artificial Sequence: Synthetic coding sequence
atggagaaggaggagaccaccagagagctgctgctgcccaactggcagggcagcggcagccacggcctgaccatcgcccagagagacgacggcgtgttcgtgcaggaggtgacccagaacagccccgccgccagaaccggcgtggtgaaggagggcgaccagatcgtgggcgccaccatctacttcgacaacctgcagagcggcgaggtgacccagctgctgaacaccatgggccaccacaccgtgggcctgaagctgcacagaaagggcgacagaagccccgagcccggccagacctggaccagagaggtgttcagcagctgcagcagcgaggtggtgctgaacaccccccagcccagcgcctag

SEQ ID NO: 9319 - DNA, 2904 bp, Artificial Sequence
  Description of Artificial Sequence: Synthetic coding sequence
atggccaagggcttctacatcagcaagagcctgggcatcctgggcatcctgctgggcgtggccgccgtgtgcaccatcatcgccctgagcgtggtgtacagccaggagaagaacaagaacgccaacagcagccccgtggccagcaccacccccagcgccagcgccaccaccaaccccgccagcgccaccaccctggaccagagcaaggcctggaacagatacagactgcccaacaccctgaagcccgacagctacagagtgaccctgagaccctacctgacccccaacgacagaggcctgtacgtgttcaagggcagcagcaccgtgagattcacctgcaaggaggccaccgacgtgatcatcatccacagcaagaagctgaactacaccctgagccagggccacagagtggtgctgagaggcgtgggcggcagccagccccccgacatcgacaagaccgagctggtggagcccaccgagtacctggtggtgcacctgaagggcagcctggtgaaggacagccagtacgagatggacagcgagttcgagggcgagctggccgacgacctggccggcttctacagaagcgagtacatggagggcaacgtgagaaaggtggtggccaccacccagatgcaggccgccgacgccagaaagagcttcccctgcttcgacgagcccgccatgaaggccgagttcaacatcaccctgatccaccccaaggacctgaccgccctgagcaacatgctgcccaagggccccagcacccccctgcccgaggaccccaactggaacgtgaccgagttccacaccacccccaagatgagcacctacctgctggccttcatcgtgagcgagttcgactacgtggagaagcaggccagcaacggcgtgctgatcagaatctgggccagacccagcgccatcgccgccggccacggcgactacgccctgaacgtgaccggccccatcctgaacttcttcgccggccactacgacaccccctaccccctgcccaagagcgaccagatcggcctgcccgacttcaacgccggcgccatggagaactggggcctggtgacctacagagagaacagcctgctgttcgaccccctgagcagcagcagcagcaacaaggagagagtggtgaccgtgatcgcccacgagctggcccaccagtggttcggcaacctggtgaccatcgagtggtggaacgacctgtggctgaacgagggcttcgccagctacgtggagtacctgggcgccgactacgccgagcccacctggaacctgaaggacctgatggtgctgaacgacgtgtacagagtgatggccgtggacgccctggccagcagccaccccctgagcacccccgccagcgagatcaacacccccgcccagatcagcgagctgttcgacgccatcagctacagcaagggcgccagcgtgctgagaatgctgagcagcttcctgagcgaggacgtgttcaagcagggcctggccagctacctgcacaccttcgcctaccagaacaccatctacctgaacctgtgggaccacctgcaggaggccgtgaacaacagaagcatccagctgcccaccaccgtgagagacatcatgaacagatggaccctgcagatgggcttccccgtgatcaccgtggacaccagcaccggcaccctgagccaggagcacttcctgctggaccccgacagcaacgtgaccagacccagcgagttcaactacgtgtggatcgtgcccatcaccagcatcagagacggcagacagcagcaggactactggctgatcgacgtgagagcccagaacgacctgttcagcaccagcggcaacgagtgggtgctgctgaacctgaacgtgaccggctactacagagtgaactacgacgaggagaactggagaaagatccagacccagctgcagagagaccacagcgccatccccgtgatcaacagagcccagatcatcaacgacgccttcaacctggccagcgcccacaaggtgcccgtgaccctggccctgaacaacaccctgttcctgatcgaggagagacagtacatgccctgggaggccgccctgagcagcctgagctacttcaagctgatgttcgacagaagcgaggtgtacggccccatgaagaactacctgaagaagcaggtgacccccctgttcatccacttcagaaacaacaccaacaactggagagagatccccgagaacctgatggaccagtacagcgaggtgaacgccatcagcaccgcctgcagcaacggcgtgcccgagtgcgaggagatggtgagcggcctgttcaagcagtggatggagaaccccaacaacaaccccatccaccccaacctgagaagcaccgtgtactgcaacgccatcgcccagggcggcgaggaggagtgggacttcgcctgggagcagttcagaaacgccaccctggtgaacgaggccgacaagctgagagccgccctggcctgcagcaaggagctgtggatcctgaacagatacctgagctacaccctgaaccccgacctgatcagaaagcaggacgccaccagcaccatcatcagcatcaccaacaacgtgatcggccagggcctggtgtgggacttcgtgcagagcaactggaagaagctgttcaacgactacggcggcggcagcttcagcttcagcaacctgatccaggccgtgaccagaagattcagcaccgagtacgagctgcagcagctggagcagttcaagaaggacaacgaggagaccggcttcggcagcggcaccagagccctggagcaggccctggagaagaccaaggccaacatcaagtgggtgaaggagaacaaggaggtggtgctgcagtggttcaccgagaacagcaagtag

SEQ ID NO: 9320 - DNA, 312 bp, Artificial Sequence
  Description of Artificial Sequence: Synthetic coding sequence
atggccaagggcttctacatcagcaagagcctgggcatcctgggcatcctgctgggcgtggccgccgtgtgcaccatcatcgccctgagcgtggtgtacagccaggagaagaacaagaacgccaacagcagccccgtggccagcaccacccccagcgccagcgccaccaccaaccccgccagcgccaccaccctggaccagagcaaggcctggaacagatacagactgcccaacaccctgaagcccgacagctacagagtgaccctgagaccctacctgacccccaacgacagaggcctgtacgtgttctag

SEQ ID NO: 9321 - DNA, 186 bp, Artificial Sequence
  Description of Artificial Sequence: Synthetic coding sequence
atggccaagggcttctacatcagcaagagcctgggcatcctgggcatcctgctgggcgtggccgccgtgtgcaccatcatcgccctgagcgtggtgtacagccaggagaagaacaagaacgccaacagcagccccgtggccagcaccacccccagcgccagcgccaccaccaaccccgccagctag

SEQ ID NO: 9322 - DNA, 381 bp, Artificial Sequence
  Description of Artificial Sequence: Synthetic coding sequence
atgaaccagaacaccgacaagatcagcggcagcggcagcaacagcgacatgatggagaacagcaaggaggagggcaccagcagcagcgagaagagcaagagcagcggcagcagcagaagcaagagaaagcccagcatcgtgaccaagtacgtggagagcgacgacgagaagcccctggacgacgagaccgtgaacgaggacgccagcaacgagaacagcgagaacgacatcaccatgcagagcctgcccaagggcaccgtgatcgtgcagcccgagcccgtgctgaacgaggacaaggacgacttcaagggccccgagttcagaagcagaagcaagatgaagaccgagaacctgaagaagagaggcggcaagtacaagtag

SEQ ID NO: 9323 - DNA, 7479 bp, Artificial Sequence
  Description of Artificial Sequence: Synthetic coding sequence
atgaccgccgagcccatgagcgagagcaagctgaacaccctggtgcagaagctgcacgacttcctggcccacagcagcgaggagagcgaggagaccagcagcccccccagactggccatgaaccagaacaccgacaagatcagcggcagcggcagcaacagcgacatgatggagaacagcaaggaggagggcaccagcagcagcgagaagagcaagagcagcggcagcagcagaagcaagagaaagcccagcatcgtgaccaagtacgtggagagcgacgacgagaagcccctggacgacgagaccgtgaacgaggacgccagcaacgagaacagcgagaacgacatcaccatgcagagcctgcccaagggcaccgtgatcgtgcagcccgagcccgtgctgaacgaggacaaggacgacttcaagggccccgagttcagaagcagaagcaagatgaagaccgagaacctgaagaagagaggcgaggacggcctgcacggcatcgtgagctgcaccgcctgcggccagcaggtgaaccacttccagaaggacagcatctacagacaccccagcctgcaggtgctgatctgcaagaactgcttcaagtactacatgagcgacgacatcagcagagacagcgacggcatggacgagcagtgcagatggtgcgccgagggcggcaacctgatctgctgcgacttctgccacaacgccttctgcaagaagtgcatcctgagaaacctgggcagaaaggagctgagcaccatcatggacgagaacaaccagtggtactgctacatctgccaccccgagcccctgctggacctggtgaccgcctgcaacagcgtgttcgagaacctggagcagctgctgcagcagaacaagaagaagatcaaggtggacagcgagaagagcaacaaggtgtacgagcacaccagcagattcagccccaagaagaccagcagcaactgcaacggcgaggagaagaagctggacgacagctgcagcggcagcgtgacctacagctacagcgccctgatcgtgcccaaggagatgatcaagaaggccaagaagctgatcgagaccaccgccaacatgaacagcagctacgtgaagttcctgaagcaggccaccgacaacagcgagatcagcagcgccaccaagctgagacagctgaaggccttcaagagcgtgctggccgacatcaagaaggcccacctggccctggaggaggacctgaacagcgagttcagagccatggacgccgtgaacaaggagaagaacaccaaggagcacaaggtgatcgacgccaagttcgagaccaaggccagaaagggcgagaagccctgcgccctggagaagaaggacatcagcaagagcgaggccaagctgagcagaaagcaggtggacagcgagcacatgcaccagaacgtgcccaccgaggagcagagaaccaacaagagcaccggcggcgagcacaagaagagcgacagaaaggaggagccccagtacgagcccgccaacaccagcgaggacctggacatggacatcgtgagcgtgcccagcagcgtgcccgaggacatcttcgagaacctggagaccgccatggaggtgcagagcagcgtggaccaccagggcgacggcagcagcggcaccgagcaggaggtggagagcagcagcgtgaagctgaacatcagcagcaaggacaacagaggcggcatcaagagcaagaccaccgccaaggtgaccaaggagctgtacgtgaagctgacccccgtgagcctgagcaacagccccatcaagggcgccgactgccaggaggtgccccaggacaaggacggctacaagagctgcggcctgaaccccaagctggagaagtgcggcctgggccaggagaacagcgacaacgagcacctggtggagaacgaggtgagcctgctgctggaggagagcgacctgagaagaagccccagagtgaagaccacccccctgagaagacccaccgagaccaaccccgtgaccagcaacagcgacgaggagtgcaacgagaccgtgaaggagaagcagaagctgagcgtgcccgtgagaaagaaggacaagagaaacagcagcgacagcgccatcgacaaccccaagcccaacaagctgcccaagagcaagcagagcgagaccgtggaccagaacagcgacagcgacgagatgctggccatcctgaaggaggtgagcagaatgagccacagcagcagcagcgacaccgacatcaacgagatccacaccaaccacaagaccctgtacgacctgaagacccaggccggcaaggacgacaagggcaagagaaagagaaagagcagcaccagcggcagcgacttcgacaccaagaagggcaagagcgccaagagcagcatcatcagcaagaagaagagacagacccagagcgagagcagcaactacgacagcgagctggagaaggagatcaagagcatgagcaagatcggcgccgccagaaccaccaagaagagaatccccaacaccaaggacttcgacagcagcgaggacgagaagcacagcaagaagggcatggacaaccagggccacaagaacctgaagaccagccaggagggcagcagcgacgacgccgagagaaagcaggagagagagaccttcagcagcgccgagggcaccgtggacaaggacaccaccatcatggagctgagagacagactgcccaagaagcagcaggccagcgccagcaccgacggcgtggacaagctgagcggcaaggagcagagcttcaccagcctggaggtgagaaaggtggccgagaccaaggagaagagcaagcacctgaagaccaagacctgcaagaaggtgcaggacggcctgagcgacatcgccgagaagttcctgaagaaggaccagagcgacgagaccagcgaggacgacaagaagcagagcaagaagggcaccgaggagaagaagaagcccagcgacttcaagaagaaggtgatcaagatggagcagcagtacgagagcagcagcgacggcaccgagaagctgcccgagagagaggagatctgccacttccccaagggcatcaagcagatcaagaacggcaccaccgacggcgagaagaagagcaagaagatcagagacaagaccagcaagaagaaggacgagctgagcgactacgccgagaagagcaccggcaagggcgacagctgcgacagcagcgaggacaagaagagcaagaacggcgcctacggcagagagaagaagagatgcaagctgctgggcaagagcagcagaaagagacaggactgcagcagcagcgacaccgagaagtacagcatgaaggaggacggctgcaacagcagcgacaagagactgaagagaatcgagctgagagagagaagaaacctgagcagcaagagaaacaccaaggagatccagagcggcagcagcagcagcgacgccgaggagagcagcgaggacaacaagaagaagaagcagagaaccagcagcaagaagaaggccgtgatcgtgaaggagaagaagagaaacagcctgagaaccagcaccaagagaaagcaggccgacatcaccagcagcagcagcagcgacatcgaggacgacgaccagaacagcatcggcgagggcagcagcgacgagcagaagatcaagcccgtgaccgagaacctggtgctgagcagccacaccggcttctgccagagcagcggcgacgaggccctgagcaagagcgtgcccgtgaccgtggacgacgacgacgacgacaacgaccccgagaacagaatcgccaagaagatgctgctggaggagatcaaggccaacctgagcagcgacgaggacggcagcagcgacgacgagcccgaggagggcaagaagagaaccggcaagcagaacgaggagaaccccggcgacgaggaggccaagaaccaggtgaacagcgagagcgacagcgacagcgaggagagcaagaagcccagatacagacacagactgctgagacacaagctgaccgtgagcgacggcgagagcggcgaggagaagaagaccaagcccaaggagcacaaggaggtgaagggcagaaacagaagaaaggtgagcagcgaggacagcgaggacagcgacttccaggagagcggcgtgagcgaggaggtgagcgagagcgaggacgagcagagacccagaaccagaagcgccaagaaggccgagctggaggagaaccagagaagctacaagcagaagaagaagagaagaagaatcaaggtgcaggaggacagcagcagcgagaacaagagcaacagcgaggaggaggaggaggagaaggaggaggaggaggaggaggaggaggaggaggaggaggaggaggaggacgagaacgacgacagcaagagccccggcaagggcagaaagaagatcagaaagatcctgaaggacgacaagctgagaaccgagacccagaacgccctgaaggaggaggaggagagaagaaagagaatcgccgagagagagagagagagagagaagctgagagaggtgatcgagatcgaggacgccagccccaccaagtgccccatcaccaccaagctggtgctggacgaggacgaggagaccaaggagcccctggtgcaggtgcacagaaacatggtgatcaagctgaagccccaccaggtggacggcgtgcagttcatgtgggactgctgctgcgagagcgtgaagaagaccaagaagagccccggcagcggctgcatcctggcccactgcatgggcctgggcaagaccctgcaggtggtgagcttcctgcacaccgtgctgctgtgcgacaagctggacttcagcaccgccctggtggtgtgccccctgaacaccgccctgaactggatgaacgagttcgagaagtggcaggagggcctgaaggacgacgagaagctggaggtgagcgagctggccaccgtgaagagaccccaggagagaagctacatgctgcagagatggcaggaggacggcggcgtgatgatcatcggctacgagatgtacagaaacctggcccagggcagaaacgtgaagagcagaaagctgaaggagatcttcaacaaggccctggtggaccccggccccgacttcgtggtgtgcgacgagggccacatcctgaagaacgaggccagcgccgtgagcaaggccatgaacagcatcagaagcagaagaagaatcatcctgaccggcacccccctgcagaacaacctgatcgagtaccactgcatggtgaacttcatcaaggagaacctgctgggcagcatcaaggagttcagaaacagattcatcaaccccatccagaacggccagtgcgccgacagcaccatggtggacgtgagagtgatgaagaagagagcccacatcctgtacgagatgctggccggctgcgtgcagagaaaggactacaccgccctgaccaagttcctgccccccaagcacgagtacgtgctggccgtgagaatgaccagcatccagtgcaagctgtaccagtactacctggaccacctgaccggcgtgggcaacaacagcgagggcggcagaggcaaggccggcgccaagctgttccaggacttccagatgctgagcagaatctggacccacccctggtgcctgcagctggactacatcagcaaggagaacaagggctacttcgacgaggacagcatggacgagttcatcgccagcgacagcgacgagaccagcatgagcctgagcagcgacgactacaccaagaagaagaagaagggcaagaagggcaagaaggacagcagcagcagcggcagcggcagcgacaacgacgtggaggtgatcaaggtgtggaacagcagaagcagaggcggcggcgagggcaacgtggacgagaccggcaacaaccccagcgtgagcctgaagctggaggagagcaaggccaccagcagcagcaaccccagcagccccgcccccgactggtacaaggacttcgtgaccgacgccgacgccgaggtgctggagcacagcggcaagatggtgctgctgttcgagatcctgagaatggccgaggagatcggcgacaaggtgctggtgttcagccagagcctgatcagcctggacctgatcgaggacttcctggagctggccagcagagagaagaccgaggacaaggacaagcccctgatctacaagggcgagggcaagtggctgagaaacatcgactactacagactggacggcagcaccaccgcccagagcagaaagaagtgggccgaggagttcaacgacgagaccaacgtgagaggcagactgttcatcatcagcaccaaggccggcagcctgggcatcaacctggtggccgccaacagagtgatcatcttcgacgccagctggaaccccagctacgacatccagagcatcttcagagtgtacagattcggccagaccaagcccgtgtacgtgtacagattcctggcccagggcaccatggaggacaagatctacgacagacaggtgaccaagcagagcctgagcttcagagtggtggaccagcagcaggtggagagacacttcaccatgaacgagctgaccgagctgtacaccttcgagcccgacctgctggacgaccccaacagcgagaagaagaagaagagagacacccccatgctgcccaaggacaccatcctggccgagctgctgcagatccacaaggagcacatcgtgggctaccacgagcacgacagcctgctggaccacaaggaggaggaggagctgaccgaggaggagagaaaggccgcctgggccgagtacgaggccgagaagaagggcctgaccatgagattcaacatccccaccggcaccaacctgccccccgtgagcttcaacagccagaccccctacatccccttcaacctgggcgccctgagcgccatgagcaaccagcagctggaggacctgatcaaccagggcagagagaaggtggtggaggccaccaacagcgtgaccgccgtgagaatccagcccctggaggacatcatcagcgccgtgtggaaggagaacatgaacctgagcgaggcccaggtgcaggccctggccctgagcagacaggccagccaggagctggacgtgaagagaagagaggccatctacaacgacgtgctgaccaagcagcagatgctgatcagctgcgtgcagagaatcctgatgaacagaagactgcagcagcagtacaaccagcagcagcagcagcagatgacctaccagcaggccaccctgggccacctgatgatgcccaagccccccaacctgatcatgaaccccagcaactaccagcagatcgacatgagaggcatgtaccagcccgtggccggcggcatgcagcccccccccctgcagagagcccccccccccatgagaagcaagaaccccggccccagccagggcaagagcatgtag

SEQ ID NO: 9324 - DNA, 7365 bp, Artificial Sequence
  Description of Artificial Sequence: Synthetic coding sequence
atgaccgccgagcccatgagcgagagcaagctgaacaccctggtgcagaagctgcacgacttcctggcccacagcagcgaggagagcgaggagaccagcagcccccccagactggccatgaaccagaacaccgacaagatcagcggcagcggcagcaacagcgacatgatggagaacagcaaggaggagggcaccagcagcagcgagaagagcaagagcagcggcagcagcagaagcaagagaaagcccagcatcgtgaccaagtacgtggagagcgacgacgagaagcccctggacgacgagaccgtgaacgaggacgccagcaacgagaacagcgagaacgacatcaccatgcagagcctgcccaaggaggacggcctgcacggcatcgtgagctgcaccgcctgcggccagcaggtgaaccacttccagaaggacagcatctacagacaccccagcctgcaggtgctgatctgcaagaactgcttcaagtactacatgagcgacgacatcagcagagacagcgacggcatggacgagcagtgcagatggtgcgccgagggcggcaacctgatctgctgcgacttctgccacaacgccttctgcaagaagtgcatcctgagaaacctgggcagaaaggagctgagcaccatcatggacgagaacaaccagtggtactgctacatctgccaccccgagcccctgctggacctggtgaccgcctgcaacagcgtgttcgagaacctggagcagctgctgcagcagaacaagaagaagatcaaggtggacagcgagaagagcaacaaggtgtacgagcacaccagcagattcagccccaagaagaccagcagcaactgcaacggcgaggagaagaagctggacgacagctgcagcggcagcgtgacctacagctacagcgccctgatcgtgcccaaggagatgatcaagaaggccaagaagctgatcgagaccaccgccaacatgaacagcagctacgtgaagttcctgaagcaggccaccgacaacagcgagatcagcagcgccaccaagctgagacagctgaaggccttcaagagcgtgctggccgacatcaagaaggcccacctggccctggaggaggacctgaacagcgagttcagagccatggacgccgtgaacaaggagaagaacaccaaggagcacaaggtgatcgacgccaagttcgagaccaaggccagaaagggcgagaagccctgcgccctggagaagaaggacatcagcaagagcgaggccaagctgagcagaaagcaggtggacagcgagcacatgcaccagaacgtgcccaccgaggagcagagaaccaacaagagcaccggcggcgagcacaagaagagcgacagaaaggaggagccccagtacgagcccgccaacaccagcgaggacctggacatggacatcgtgagcgtgcccagcagcgtgcccgaggacatcttcgagaacctggagaccgccatggaggtgcagagcagcgtggaccaccagggcgacggcagcagcggcaccgagcaggaggtggagagcagcagcgtgaagctgaacatcagcagcaaggacaacagaggcggcatcaagagcaagaccaccgccaaggtgaccaaggagctgtacgtgaagctgacccccgtgagcctgagcaacagccccatcaagggcgccgactgccaggaggtgccccaggacaaggacggctacaagagctgcggcctgaaccccaagctggagaagtgcggcctgggccaggagaacagcgacaacgagcacctggtggagaacgaggtgagcctgctgctggaggagagcgacctgagaagaagccccagagtgaagaccacccccctgagaagacccaccgagaccaaccccgtgaccagcaacagcgacgaggagtgcaacgagaccgtgaaggagaagcagaagctgagcgtgcccgtgagaaagaaggacaagagaaacagcagcgacagcgccatcgacaaccccaagcccaacaagctgcccaagagcaagcagagcgagaccgtggaccagaacagcgacagcgacgagatgctggccatcctgaaggaggtgagcagaatgagccacagcagcagcagcgacaccgacatcaacgagatccacaccaaccacaagaccctgtacgacctgaagacccaggccggcaaggacgacaagggcaagagaaagagaaagagcagcaccagcggcagcgacttcgacaccaagaagggcaagagcgccaagagcagcatcatcagcaagaagaagagacagacccagagcgagagcagcaactacgacagcgagctggagaaggagatcaagagcatgagcaagatcggcgccgccagaaccaccaagaagagaatccccaacaccaaggacttcgacagcagcgaggacgagaagcacagcaagaagggcatggacaaccagggccacaagaacctgaagaccagccaggagggcagcagcgacgacgccgagagaaagcaggagagagagaccttcagcagcgccgagggcaccgtggacaaggacaccaccatcatggagctgagagacagactgcccaagaagcagcaggccagcgccagcaccgacggcgtggacaagctgagcggcaaggagcagagcttcaccagcctggaggtgagaaaggtggccgagaccaaggagaagagcaagcacctgaagaccaagacctgcaagaaggtgcaggacggcctgagcgacatcgccgagaagttcctgaagaaggaccagagcgacgagaccagcgaggacgacaagaagcagagcaagaagggcaccgaggagaagaagaagcccagcgacttcaagaagaaggtgatcaagatggagcagcagtacgagagcagcagcgacggcaccgagaagctgcccgagagagaggagatctgccacttccccaagggcatcaagcagatcaagaacggcaccaccgacggcgagaagaagagcaagaagatcagagacaagaccagcaagaagaaggacgagctgagcgactacgccgagaagagcaccggcaagggcgacagctgcgacagcagcgaggacaagaagagcaagaacggcgcctacggcagagagaagaagagatgcaagctgctgggcaagagcagcagaaagagacaggactgcagcagcagcgacaccgagaagtacagcatgaaggaggacggctgcaacagcagcgacaagagactgaagagaatcgagctgagagagagaagaaacctgagcagcaagagaaacaccaaggagatccagagcggcagcagcagcagcgacgccgaggagagcagcgaggacaacaagaagaagaagcagagaaccagcagcaagaagaaggccgtgatcgtgaaggagaagaagagaaacagcctgagaaccagcaccaagagaaagcaggccgacatcaccagcagcagcagcagcgacatcgaggacgacgaccagaacagcatcggcgagggcagcagcgacgagcagaagatcaagcccgtgaccgagaacctggtgctgagcagccacaccggcttctgccagagcagcggcgacgaggccctgagcaagagcgtgcccgtgaccgtggacgacgacgacgacgacaacgaccccgagaacagaatcgccaagaagatgctgctggaggagatcaaggccaacctgagcagcgacgaggacggcagcagcgacgacgagcccgaggagggcaagaagagaaccggcaagcagaacgaggagaaccccggcgacgaggaggccaagaaccaggtgaacagcgagagcgacagcgacagcgaggagagcaagaagcccagatacagacacagactgctgagacacaagctgaccgtgagcgacggcgagagcggcgaggagaagaagaccaagcccaaggagcacaaggaggtgaagggcagaaacagaagaaaggtgagcagcgaggacagcgaggacagcgacttccaggagagcggcgtgagcgaggaggtgagcgagagcgaggacgagcagagacccagaaccagaagcgccaagaaggccgagctggaggagaaccagagaagctacaagcagaagaagaagagaagaagaatcaaggtgcaggaggacagcagcagcgagaacaagagcaacagcgaggaggaggaggaggagaaggaggaggaggaggaggaggaggaggaggaggaggaggaggaggaggacgagaacgacgacagcaagagccccggcaagggcagaaagaagatcagaaagatcctgaaggacgacaagctgagaaccgagacccagaacgccctgaaggaggaggaggagagaagaaagagaatcgccgagagagagagagagagagagaagctgagagaggtgatcgagatcgaggacgccagccccaccaagtgccccatcaccaccaagctggtgctggacgaggacgaggagaccaaggagcccctggtgcaggtgcacagaaacatggtgatcaagctgaagccccaccaggtggacggcgtgcagttcatgtgggactgctgctgcgagagcgtgaagaagaccaagaagagccccggcagcggctgcatcctggcccactgcatgggcctgggcaagaccctgcaggtggtgagcttcctgcacaccgtgctgctgtgcgacaagctggacttcagcaccgccctggtggtgtgccccctgaacaccgccctgaactggatgaacgagttcgagaagtggcaggagggcctgaaggacgacgagaagctggaggtgagcgagctggccaccgtgaagagaccccaggagagaagctacatgctgcagagatggcaggaggacggcggcgtgatgatcatcggctacgagatgtacagaaacctggcccagggcagaaacgtgaagagcagaaagctgaaggagatcttcaacaaggccctggtggaccccggccccgacttcgtggtgtgcgacgagggccacatcctgaagaacgaggccagcgccgtgagcaaggccatgaacagcatcagaagcagaagaagaatcatcctgaccggcacccccctgcagaacaacctgatcgagtaccactgcatggtgaacttcatcaaggagaacctgctgggcagcatcaaggagttcagaaacagattcatcaaccccatccagaacggccagtgcgccgacagcaccatggtggacgtgagagtgatgaagaagagagcccacatcctgtacgagatgctggccggctgcgtgcagagaaaggactacaccgccctgaccaagttcctgccccccaagcacgagtacgtgctggccgtgagaatgaccagcatccagtgcaagctgtaccagtactacctggaccacctgaccggcgtgggcaacaacagcgagggcggcagaggcaaggccggcgccaagctgttccaggacttccagatgctgagcagaatctggacccacccctggtgcctgcagctggactacatcagcaaggagaacaagggctacttcgacgaggacagcatggacgagttcatcgccagcgacagcgacgagaccagcatgagcctgagcagcgacgactacaccaagaagaagaagaagggcaagaagggcaagaaggacagcagcagcagcggcagcggcagcgacaacgacgtggaggtgatcaaggtgtggaacagcagaagcagaggcggcggcgagggcaacgtggacgagaccggcaacaaccccagcgtgagcctgaagctggaggagagcaaggccaccagcagcagcaaccccagcagccccgcccccgactggtacaaggacttcgtgaccgacgccgacgccgaggtgctggagcacagcggcaagatggtgctgctgttcgagatcctgagaatggccgaggagatcggcgacaaggtgctggtgttcagccagagcctgatcagcctggacctgatcgaggacttcctggagctggccagcagagagaagaccgaggacaaggacaagcccctgatctacaagggcgagggcaagtggctgagaaacatcgactactacagactggacggcagcaccaccgcccagagcagaaagaagtgggccgaggagttcaacgacgagaccaacgtgagaggcagactgttcatcatcagcaccaaggccggcagcctgggcatcaacctggtggccgccaacagagtgatcatcttcgacgccagctggaaccccagctacgacatccagagcatcttcagagtgtacagattcggccagaccaagcccgtgtacgtgtacagattcctggcccagggcaccatggaggacaagatctacgacagacaggtgaccaagcagagcctgagcttcagagtggtggaccagcagcaggtggagagacacttcaccatgaacgagctgaccgagctgtacaccttcgagcccgacctgctggacgaccccaacagcgagaagaagaagaagagagacacccccatgctgcccaaggacaccatcctggccgagctgctgcagatccacaaggagcacatcgtgggctaccacgagcacgacagcctgctggaccacaaggaggaggaggagctgaccgaggaggagagaaaggccgcctgggccgagtacgaggccgagaagaagggcctgaccatgagattcaacatccccaccggcaccaacctgccccccgtgagcttcaacagccagaccccctacatccccttcaacctgggcgccctgagcgccatgagcaaccagcagctggaggacctgatcaaccagggcagagagaaggtggtggaggccaccaacagcgtgaccgccgtgagaatccagcccctggaggacatcatcagcgccgtgtggaaggagaacatgaacctgagcgaggcccaggtgcaggccctggccctgagcagacaggccagccaggagctggacgtgaagagaagagaggccatctacaacgacgtgctgaccaagcagcagatgctgatcagctgcgtgcagagaatcctgatgaacagaagactgcagcagcagtacaaccagcagcagcagcagcagatgacctaccagcaggccaccctgggccacctgatgatgcccaagccccccaacctgatcatgaaccccagcaactaccagcagatcgacatgagaggcatgtaccagcccgtggccggcggcatgcagcccccccccctgcagagagcccccccccccatgagaagcaagaaccccggccccagccagggcaagagcatgtag

SEQ ID NO: 9325 - DNA, 369 bp, Artificial Sequence
  Description of Artificial Sequence: Synthetic coding sequence
atcaactacaacagagacaagatcagcggcagcggcagcaacagcgacatgatggagaacagcaaggaggagggcaccagcagcagcgagaagagcaagagcagcggcagcagcagaagcaagagaaagcccagcatcgtgaccaagtacgtggagagcgacgacgagaagcccctggacgacgagaccgtgaacgaggacgccagcaacgagaacagcgagaacgacatcaccatgcagagcctgcccaagggcaccgtgatcgtgcagcccgagcccgtgctgaacgaggacaaggacgacttcaagggccccgagttcagaagcagaagcaagatgaagaccgagaacctgaagaagagaggctag

SEQ ID NO: 9326 - DNA, 4038 bp, Artificial Sequence
  Description of Artificial Sequence: Synthetic coding sequence
atgagcgagagcaagctgaacaccctggtgcagaagctgcacgacttcctggcccacagcagcgaggagagcgaggagaccagcagcccccccagactggccatgaaccagaacaccgacaagatcagcggcagcggcagcaacagcgacatgatggagaacagcaaggaggagggcaccagcagcagcgagaagagcaagagcagcggcagcagcagaagcaagagaaagcccagcatcgtgaccaagtacgtggagagcgacgacgagaagcccctggacgacgagaccgtgaacgaggacgccagcaacgagaacagcgagaacgacatcaccatgcagagcctgcccaaggacggcctgcacggcatcgtgagctgcaccgcctgcggccagcaggtgaaccacttccagaaggacagcatctacagacaccccagcctgcaggtgctgatctgcaagaactgcttcaagtactacatgagcgacgacatcagcagagacagcgacggcatggacgagcagtgcagatggtgcgccgagggcggcaacctgatctgctgcgacttctgccacaacgccttctgcaagaagtgcatcctgagaaacctgggcagaaaggagctgagcaccatcatggacgagaacaaccagtggtactgctacatctgccaccccgagcccctgctggacctggtgaccgcctgcaacagcgtgttcgagaacctggagcagctgctgcagcagaacaagaagaagatcaaggtggacagcgagaagagcaacaaggtgtacgagcacaccagcagattcagccccaagaagaccagcagcaactgcaacggcgaggagaagaagctggacgacagctgcagcggcagcgtgacctacagctacagcgccctgatcgtgcccaaggagatgatcaagaaggccaagaagctgatcgagaccaccgccaacatgaacagcagctacgtgaagttcctgaagcaggccaccgacaacagcgagatcagcagcgccaccaagctgagacagctgaaggccttcaagagcgtgctggccgacatcaagaaggcccacctggccctggaggaggacctgaacagcgagttcagagccatggacgccgtgaacaaggagaagaacaccaaggagcacaaggtgatcgacgccaagttcgagaccaaggccagaaagggcgagaagccctgcgccctggagaagaaggacatcagcaagagcgaggccaagctgagcagaaagcaggtggacagcgagcacatgcaccagaacgtgcccaccgaggagcagagaaccaacaagagcaccggcggcgagcacaagaagagcgacagaaaggaggagccccagtacgagcccgccaacaccagcgaggacctggacatggacatcgtgagcgtgcccagcagcgtgcccgaggacatcttcgagaacctggagaccgccatggaggtgcagagcagcgtggaccaccagggcgacggcagcagcggcaccgagcaggaggtggagagcagcagcgtgaagctgaacatcagcagcaaggacaacagaggcggcgccgactgccaggaggtgccccaggacaaggacggctacaagagctgcggcctgaaccccaagctggagaagtgcggcctgggccaggagaacagcgacaacgagcacctggtggagaacgaggtgagcctgctgctggaggagagcgacctgagaagaagccccagagtgaagaccacccccctgagaagacccaccgagaccaaccccgtgaccagcaacagcgacgaggagtgcaacgagaccgtgaaggagaagcagaagctgagcgtgcccgtgagaaagaaggacaagagaaacagcagcgacagcgccatcgacaaccccaagcccaacaagctgcccaagagcaagcagagcgagaccgtggaccagaacagcgacagcgacgagatgctggccatcctgaaggaggtgagcagaatgagccacagcagcagcagcgacaccgacatcaacgagatccacaccaaccacaagaccctgtacgacctgaagacccaggccggcaaggacgacaagggcaagagaaagagaaagagcagcaccagcggcagcgacttcgacaccaagaagggcaagagcgccaagagcagcatcatcagcaagaagaagagacagacccagagcgagagcagcaactacgacagcgagctggagaaggagatcaagagcatgagcaagatcggcgccgccagaaccaccaagaagagaatccccaacaccaaggacttcgacagcagcgaggacgagaagcacagcaagaagggcatggacaaccagggccacaagaacctgaagaccagccaggagggcagcagcgacgacgccgagagaaagcaggagagagagaccttcagcagcgccgagggcaccgtggacaaggacaccaccatcatggagctgagagacagactgcccaagaagcagcaggccagcgccagcaccgacggcgtggacaagctgagcggcaaggagcagagcttcaccagcctggaggtgagaaaggtggccgagaccaaggagaagagcaagcacctgaagaccaagacctgcaagaaggtgcaggacggcctgagcgacatcgccgagaagttcctgaagaaggaccagagcgacgagaccagcgaggacgacaagaagcagagcaagaagggcaccgaggagaagaagaagcccagcgacttcaagaagaaggtgatcaagatggagcagcagtacgagagcagcagcgacggcaccgagaagctgcccgagagagaggagatctgccacttccccaagggcatcaagcagatcaagaacggcaccaccgacggcgagaagaagagcaagaagatcagagacaagaccagcaagaagaaggacgagctgagcgactacgccgagaagagcaccggcaagggcgacagctgcgacagcagcgaggacaagaagagcaagaacggcgcctacggcagagagaagaagagatgcaagctgctgggcaagagcagcagaaagagacaggactgcagcagcagcgacaccgagaagtacagcatgaaggaggacggctgcaacagcagcgacaagagactgaagagaatcgagctgagagagagaagaaacctgagcagcaagagaaacaccaaggagatccagagcggcagcagcagcagcgacgccgaggagagcagcgaggacaacaagaagaagaagcagagaaccagcagcaagaagaaggccgtgatcgtgaaggagaagaagagaaacagcctgagaaccagcaccaagagaaagcaggccgacatcaccagcagcagcagcagcgacatcgaggacgacgaccagaacagcatcggcgagggcagcagcgacgagcagaagatcaagcccgtgaccgagaacctggtgctgagcagccacaccggcttctgccagagcagcggcgacgaggccctgagcaagagcgtgcccgtgaccgtggacgacgacgacgacgacaacgaccccgagaacagaatcgccaagaagatgctgctggaggagatcaaggccaacctgagcagcgacgaggacggcagcagcgacgacgagcccgaggagggcaagaagagaaccggcaagcagaacgaggagaaccccggcgacgaggaggccaagaaccaggtgaacagcgagagcgacagcgacagcgaggagagcaagaagcccagatacagacacagactgctgagacacaagctgaccgtgagcgacggcgagagcggcgaggagaagaagaccaagcccaaggagcacaaggaggtgaagggcagaaacagaagaaaggtgagcagcgaggacagcgaggacagcgacttccaggagagcggcgtgagcgaggaggtgagcgagagcgaggacgagcagagacccagaaccagaagcgccaagaaggccgagctggaggagaaccagagaagctag

SEQ ID NO: 9327 - DNA, 483 bp, Artificial Sequence
  Description of Artificial Sequence: Synthetic coding sequence
tgacccgacttcgtggtgtgcgacgagggccacatcctgaagaacgaggccagcgccgtgagcaaggccatgaacagcatcagaagcagaagaagaatcatcctgaccggcacccccctgcagaacaacctgatcgagtaccactgcatggtgaacttcatcaaggagaacctgctgggcagcatcaaggagttcagaaacagattcatcaaccccatccagaacggccagtgcgccgacagcaccatggtggacgtgagagtgatgaagaagagagcccacatcctgtacgagatgctggccggctgcgtgcagagaaaggactacaccgccctgaccaagttcctgccccccaagcacgagtacgtgctggccgtgagaatgaccagcatccagtgcaagctgtaccagtactacctggaccacctgaccgtgctgcacctgaacaagatgggcatgctgaagagcatcaagtacttctag

SEQ ID NO: 9328 - DNA, 2514 bp, Artificial Sequence
  Description of Artificial Sequence: Synthetic coding sequence
atgaaccacctggagggcagcgccgaggtggaggtgaccgacgaggccgccggcggcgaggtgaacgagagcgtggaggccgacctggagcaccccgaggtggaggaggagcagcagcagcccccccagcagcagcactacgtgggcagacaccagagaggcagagccctggaggacctgagagcccagctgggccaggaggaggaggagagaggcgagtgcctggccagaagcgccagcaccgagagcggcttccacaaccacaccgacaccgccgagggcgacgtgatcgccgccgccagagacggctacgacgccgagagagcccaggaccccgaggacgagagcgcctacgccgtgcagtacagacccgaggccgaggagtacaccgagcaggccgaggccgagcacgccgaggccacccacagaagagccctgcccaaccacctgcacttccacagcctggagcacgaggaggccatgaacgccgcctacagcggctacgtgtacacccacagactgttccacagaggcgaggacgagccctacagcgagccctacgccgactacggcggcctgcaggagcacgtgtacgaggagatcggcgacgcccccgagctggacgccagagacggcctgagactgtacgagcaggagagagacgaggccgccgcctacagacaggaggccctgggcgccagactgcaccactacgacgagagaagcgacggcgagagcgacagccccgagaaggaggccgagttcgccccctaccccagaatggacagctacgagcaggaggaggacatcgaccagatcgtggccgaggtgaagcagagcatgagcagccagagcctggacaaggccgccgaggacatgcccgaggccgagcaggacctggagagaccccccacccccgccggcggcagacccgacagccccggcctgcaggcccccgccggccagcagagagccgtgggccccgccggcggcggcgaggccggccagagatacagcaaggagaagagagacgccatcagcctggccatcaaggacatcaaggaggccatcgaggaggtgaagaccagaaccatcagaagcccctacacccccgacgagcccaaggagcccatctgggtgatgagacaggacatcagccccaccagagactgcgacgaccagagacccatggacggcgacagccccagccccggcagcagcagccccctgggcgccgagagcagcagcaccagcctgcaccccagcgaccccgtggaggccagcaccaacaaggagagcagaaagagcctggccagcttccccacctacgtggaggtgcccggcccctgcgaccccgaggacctgatcgacggcatcatcttcgccgccaactacctgggcagcacccagctgctgagcgacaagacccccagcaagaacgtgagaatgatgcaggcccaggaggccgtgagcagaatcaagatggcccagaagctggccaagagcagaaagaaggcccccgagggcgagagccagcccatgaccgaggtggacctgttcatcagcacccagagaatcaaggtgctgaacgccgacacccaggagaccatgatggaccaccccctgagaaccatcagctacatcgccgacatcggcaacatcgtggtgctgatggccagaagaagaatgcccagaagcaacagccaggagaacgtggaggccagccaccccagccaggacggcaagagacagtacaagatgatctgccacgtgttcgagagcgaggacgcccagctgatcgcccagagcatcggccaggccttcagcgtggcctaccaggagttcctgagagccaacggcatcaaccccgaggacctgagccagaaggagtacagcgacctgctgaacacccaggacatgtacaacgacgacctgatccacttcagcaagagcgagaactgcaaggacgtgttcatcgagaagcagaagggcgagatcctgggcgtggtgatcgtggagagcggctggggcagcatcctgcccaccgtgatcatcgccaacatgatgcacggcggccccgccgagaagagcggcaagctgaacatcggcgaccagatcatgagcatcaacggcaccagcctggtgggcctgcccctgagcacctgccagagcatcatcaagggcctgaagaaccagagcagagtgaagctgaacatcgtgagatgcccccccgtgaccaccgtgctgatcagaagacccgacctgagataccagctgggcttcagcgtgcagaacggcatcatctgcagcctgatgagaggcggcatcgccgagagaggcggcgtgagagtgggccacagaatcatcgagatcaacggccagagcgtggtggccaccccccacgagaagatcgtgcacatcctgagcaacgccgtgggcgagatccacatgaagaccatgcccgccgccatgtacagactgctgaccgcccaggagcagcccgtgtacatctag

SEQ ID NO: 9329 - DNA, 2469 bp, Artificial Sequence
  Description of Artificial Sequence: Synthetic coding sequence
atggccgccgccgtggtggtggccgagggcgacagcgacagcagacccggccaggagctgctggtggcctggaacaccgtgagcaccggcctggtgccccccgccgccctgggcctggtgagcagcagaaccagcggcgccgtgccccccaaggaggaggagctgagagccgccgtggaggtgctgagaggccacggcctgcacagcgtgctggaggagtggttcgtggaggtgctgcagaacgacctgcaggccaacatcagccccgagttctggaacgccatcagccagtgcgagaacagcgccgacgagccccagtgcctgctgctgctgctggacgccttcggcctgctggagagcagactggacccctacctgagaagcctggagctgctggagaagtggaccagactgggcctgctgatgggcaccggcgcccagggcctgagagaggaggtgcacaccatgctgagaggcgtgctgttcttcagcacccccagaaccttccaggagatgatccagagactgtacggctgcttcctgagagtgtacatgcagagcaagagaaagggcgagggcggcaccgaccccgagctggagggcgagctggacagcagatacgccagaagaagatactacagactgctgcagagccccctgtgcgccggctgcagcagcgacaagcagcagtgctggtgcagacaggccctggagcagttccaccagctgagccaggtgctgcacagactgagcctgctggagagagtgagcgccgaggccgtgaccaccaccctgcaccaggtgaccagagagagaatggaggacagatgcagaggcgagtacgagagaagcttcctgagagagttccacaagtggatcgagagagtggtgggctggctgggcaaggtgttcctgcaggacggccccgccagacccgccagccccgaggccggcaacaccctgagaagatggagatgccacgtgcagagattcttctacagaatctacgccagcctgagaatcgaggagctgttcagcatcgtgagagacttccccgacagcagacccgccatcgaggacctgaagtactgcctggagagaaccgaccagagacagcagctgctggtgagcctgaaggccgccctggagaccagactgctgcaccccggcgtgaacacctgcgacatcatcaccctgtacatcagcgccatcaaggccctgagagtgctggaccccagcatggtgatcctggaggtggcctgcgagcccatcagaagatacctgagaaccagagaggacaccgtgagacagatcgtggccggcctgaccggcgacagcgacggcaccggcgacctggccgtggagctgagcaagaccgaccccgccagcctggagaccggccaggacagcgaggacgacagcggcgagcccgaggactgggtgcccgaccccgtggacgccgaccccggcaagagcagcagcaagagaagaagcagcgacatcatcagcctgctggtgagcatctacggcagcaaggacctgttcatcaacgagtacagaagcctgctggccgacagactgctgcaccagttcagcttcagccccgagagagagatcagaaacgtggagctgctgaagctgagattcggcgaggcccccatgcacttctgcgaggtgatgctgaaggacatggccgacagcagaagaatcaacgccaacatcagagaggaggacgagaagagacccgccgaggagcagccccccttcggcgtgtacgccgtgatcctgagcagcgagttctggccccccttcaaggacgagaagctggaggtgcccgaggacatcagagccgccctggaggcctactgcaagaagtacgagcagctgaaggccatgagaaccctgagctggaagcacaccctgggcctggtgaccatggacgtggagctggccgacagaaccctgagcgtggccgtgacccccgtgcaggccgtgatcctgctgtacttccaggaccaggccagctggaccctggaggagctgagcaaggccgtgaagatgcccgtggccctgctgagaagaagaatgagcgtgtggctgcagcagggcgtgctgagagaggagccccccggcaccttcagcgtgatcgaggaggagagaccccaggacagagacaacatggtgctgatcgacagcgacgacgagagcgacagcggcatggccagccaggccgaccagaaggaggaggagctgctgctgttctggacctacatccaggccatgctgaccaacctggagagcctgagcctggacagaatctacaacatgctgagaatgttcgtggtgaccggccccgccctggccgagatcgacctgcaggagctgcagggctacctgcagaagaaggtgagagaccagcagctggtgtacagcgccggcgtgtacagactgcccaagaactgcagctag

SEQ ID NO: 9330 - DNA, 4863 bp, Artificial Sequence
  Description of Artificial Sequence: Synthetic coding sequence
atgggcgccatcggcctgctgtggctgctgcccctgctgctgagcaccgccgccgtgggcagcggcatgggcaccggccagagagccggcagccccgccgccggcccccccctgcagcccagagagcccctgagctacagcagactgcagagaaagagcctggccgtggacttcgtggtgcccagcctgttcagagtgtacgccagagacctgctgctgccccccagcagcagcgagctgaaggccggcagacccgaggccagaggcagcctggccctggactgcgcccccctgctgagactgctgggccccgcccccggcgtgagctggaccgccggcagccccgcccccgccgaggccagaaccctgagcagagtgctgaagggcggcagcgtgagaaagctgagaagagccaagcagctggtgctggagctgggcgaggaggccatcctggagggctgcgtgggcccccccggcgaggccgccgtgggcctgctgcagttcaacctgagcgagctgttcagctggtggatcagacagggcgagggcagactgagaatcagactgatgcccgagaagaaggccagcgaggtgggcagagagggcagactgagcgccgccatcagagccagccagcccagactgctgttccagatcttcggcaccggccacagcagcctggagagccccaccaacatgcccagccccagccccgactacttcacctggaacctgacctggatcatgaaggacagcttccccttcctgagccacagaagcagatacggcctggagtgcagcttcgacttcccctgcgagctggagtacagcccccccctgcacgacctgagaaaccagagctggagctggagaagaatccccagcgaggaggccagccagatggacctgctggacggccccggcgccgagagaagcaaggagatgcccagaggcagcttcctgctgctgaacaccagcgccgacagcaagcacaccatcctgagcccctggatgagaagcagcagcgagcactgcaccctggccgtgagcgtgcacagacacctgcagcccagcggcagatacatcgcccagctgctgccccacaacgaggccgccagagagatcctgctgatgcccacccccggcaagcacggctggaccgtgctgcagggcagaatcggcagacccgacaaccccttcagagtggccctggagtacatcagcagcggcaacagaagcctgagcgccgtggacttcttcgccctgaagaactgcagcgagggcaccagccccggcagcaagatggccctgcagagcagcttcacctgctggaacggcaccgtgctgcagctgggccaggcctgcgacttccaccaggactgcgcccagggcgaggacgagagccagatgtgcagaaagctgcccgtgggcttctactgcaacttcgaggacggcttctgcggctggacccagggcaccctgagcccccacaccccccagtggcaggtgagaaccctgaaggacgccagattccaggaccaccaggaccacgccctgctgctgagcaccaccgacgtgcccgccagcgagagcgccaccgtgaccagcgccaccttccccgcccccatcaagagcagcccctgcgagctgagaatgagctggctgatcagaggcgtgctgagaggcaacgtgagcctggtgctggtggagaacaagaccggcaaggagcagggcagaatggtgtggcacgtggccgcctacgagggcctgagcctgtggcagtggatggtgctgcccctgctggacgtgagcgacagattctggctgcagatggtggcctggtggggccagggcagcagagccatcgtggccttcgacaacatcagcatcagcctggactgctacctgaccatcagcggcgaggacaagatcctgcagaacaccgcccccaagagcagaaacctgttcgagagaaaccccaacaaggagctgaagcccggcgagaacagccccagacagacccccatcttcgaccccaccgtgcactggctgttcaccacctgcggcgccagcggcccccacggccccacccaggcccagtgcaacaacgcctaccagaacagcaacctgagcgtggaggtgggcagcgagggccccctgaagggcatccagatctggaaggtgcccgccaccgacacctacagcatcagcggctacggcgccgccggcggcaagggcggcaagaacaccatgatgagaagccacggcgtgagcgtgctgggcatcttcaacctggagaaggacgacatgctgtacatcctggtgggccagcagggcgaggacgcctgccccagcaccaaccagctgatccagaaggtgtgcatcggcgagaacaacgtgatcgaggaggagatcagagtgaacagaagcgtgcacgagtgggccggcggcggcggcggcggcggcggcgccacctacgtgttcaagatgaaggacggcgtgcccgtgcccctgatcatcgccgccggcggcggcggcagagcctacggcgccaagaccgacaccttccaccccgagagactggagaacaacagcagcgtgctgggcctgaacggcaacagcggcgccgccggcggcggcggcggctggaacgacaacaccagcctgctgtgggccggcaagagcctgcaggagggcgccaccggcggccacagctgcccccaggccatgaagaagtggggctgggagaccagaggcggcttcggcggcggcggcggcggctgcagcagcggcggcggcggcggcggctacatcggcggcaacgccgccagcaacaacgaccccgagatggacggcgaggacggcgtgagcttcatcagccccctgggcatcctgtacacccccgccctgaaggtgatggagggccacggcgaggtgaacatcaagcactacctgaactgcagccactgcgaggtggacgagtgccacatggaccccgagagccacaaggtgatctgcttctgcgaccacggcaccgtgctggccgaggacggcgtgagctgcatcgtgagccccacccccgagccccacctgcccctgagcctgatcctgagcgtggtgaccagcgccctggtggccgccctggtgctggccttcagcggcatcatgatcgtgtacagaagaaagcaccaggagctgcaggccatgcagatggagctgcagagccccgagtacaagctgagcaagctgagaaccagcaccatcatgaccgactacaaccccaactactgcttcgccggcaagaccagcagcatcagcgacctgaaggaggtgcccagaaagaacatcaccctgatcagaggcctgggccacggcgccttcggcgaggtgtacgagggccaggtgagcggcatgcccaacgaccccagccccctgcaggtggccgtgaagaccctgcccgaggtgtgcagcgagcaggacgagctggacttcctgatggaggccctgatcatcagcaagttcaaccaccagaacatcgtgagatgcatcggcgtgagcctgcagagcctgcccagattcatcctgctggagctgatggccggcggcgacctgaagagcttcctgagagagaccagacccagacccagccagcccagcagcctggccatgctggacctgctgcacgtggccagagacatcgcctgcggctgccagtacctggaggagaaccacttcatccacagagacatcgccgccagaaactgcctgctgacctgccccggccccggcagagtggccaagatcggcgacttcggcatggccagagacatctacagagccagctactacagaaagggcggctgcgccatgctgcccgtgaagtggatgccccccgaggccttcatggagggcatcttcaccagcaagaccgacacctggagcttcggcgtgctgctgtgggagatcttcagcctgggctacatgccctaccccagcaagagcaaccaggaggtgctggagttcgtgaccagcggcggcagaatggacccccccaagaactgccccggccccgtgtacagaatcatgacccagtgctggcagcaccagcccgaggacagacccaacttcgccatcatcctggagagaatcgagtactgcacccaggaccccgacgtgatcaacaccgccctgcccatcgagtacggccccctggtggaggaggaggagaaggtgcccgtgagacccaaggaccccgagggcgtgccccccctgctggtgagccagcaggccaagagagaggaggagagaagccccgccgcccccccccccctgcccaccaccagcagcggcaaggccgccaagaagcccaccgccgccgagatcagcgtgagagtgcccagaggccccgccgtggagggcggccacgtgaacatggccttcagccagagcaacccccccagcgagctgcacaaggtgcacggcagcagaaacaagcccaccagcctgtggaaccccacctacggcagctggttcaccgagaagcccaccaagaagaacaaccccatcgccaagaaggagccccacgacagaggcaacctgggcctggagggcagctgcaccgtgccccccaacgtggccaccggcagactgcccggcgccagcctgctgctggagcccagcagcctgaccgccaacatgaaggaggtgcccctgttcagactgagacacttcccctgcggcaacgtgaactacggctaccagcagcagggcctgcccctggaggccgccaccgcccccggcgccggccactacgaggacaccatcctgaagagcaagaacagcatgaaccagcccggcccctag

SEQ ID NO: 9331 - DNA, 1353 bp, Artificial Sequence
  Description of Artificial Sequence: Synthetic coding sequence
atgggcgccatcggcctgctgtggctgctgcccctgctgctgagcaccgccgccgtgggcagcggcatgggcaccggccagagagccggcagccccgccgccggcccccccctgcagcccagagagcccctgagctacagcagactgcagagaaagagcctggccgtggacttcgtggtgcccagcctgttcagagtgtacgccagagacctgctgctgccccccagcagcagcgagctgaaggccggcagacccgaggccagaggcagcctggccctggactgcgcccccctgctgagactgctgggccccgcccccggcgtgagctggaccgccggcagccccgcccccgccgaggccagaaccctgagcagagtgctgaagggcggcagcgtgagaaagctgagaagagccaagcagctggtgctggagctgggcgaggaggccatcctggagggctgcgtgggcccccccggcgaggccgccgtgggcctgctgcagttcaacctgagcgagctgttcagctggtggatcagacagggcgagggcagactgagaatcagactgatgcccgagaagaaggccagcgaggtgggcagagagggcagactgagcgccgccatcagagccagccagcccagactgctgttccagatcttcggcaccggccacagcagcctggagagccccaccaacatgcccagccccagccccgactacttcacctggaacctgacctggatcatgaaggacagcttccccttcctgagccacagaagcagatacggcaaggagagaagccccgccgcccccccccccctgcccaccaccagcagcggcaaggccgccaagaagcccaccgccgccgagatcagcgtgagagtgcccagaggccccgccgtggagggcggccacgtgaacatggccttcagccagagcaacccccccagcgagctgcacaaggtgcacggcagcagaaacaagcccaccagcctgtggaaccccacctacggcagctggttcaccgagaagcccaccaagaagaacaaccccatcgccaagaaggagccccacgacagaggcaacctgggcctggagggcagctgcaccgtgccccccaacgtggccaccggcagactgcccggcgccagcctgctgctggagcccagcagcctgaccgccaacatgaaggaggtgcccctgttcagactgagacacttcccctgcggcaacgtgaactacggctaccagcagcagggcctgcccctggaggccgccaccgcccccggcgccggccactacgaggacaccatcctgaagagcaagaacagcatgaaccagcccggcccctag

SEQ ID NO: 9332 - DNA, 1935 bp, Artificial Sequence
  Description of Artificial Sequence: Synthetic coding sequence
atggaggtgcagctgggcctgggcagagtgtaccccagaccccccagcaagacctacagaggcgccttccagaacctgttccagagcgtgagagaggtgatccagaaccccggccccagacaccccgaggccgccagcgccgccccccccggcgccagcctgctgctgctgcagcagcagcagcagcagcagcagcagcagcagcagcagcagcagcagcagcagcagcagcagcagcaggagaccagccccagacagcagcagcagcagcagggcgaggacggcagcccccaggcccacagaagaggccccaccggctacctggtgctggacgaggagcagcagcccagccagccccagagcgccctggagtgccaccccgagagaggctgcgtgcccgagcccggcgccgccgtggccgccagcaagggcctgccccagcagctgcccgccccccccgacgaggacgacagcgccgcccccagcaccctgagcctgctgggccccaccttccccggcctgagcagctgcagcgccgacctgaaggacatcctgagcgaggccagcaccatgcagctgctgcagcagcagcagcaggaggccgtgagcgagggcagcagcagcggcagagccagagaggccagcggcgcccccaccagcagcaaggacaactacctgggcggcaccagcaccatcagcgacaacgccaaggagctgtgcaaggccgtgagcgtgagcatgggcctgggcgtggaggccctggagcacctgagccccggcgagcagctgagaggcgactgcatgtacgcccccctgctgggcgtgccccccgccgtgagacccaccccctgcgcccccctggccgagtgcaagggcagcctgctggacgacagcgccggcaagagcaccgaggacaccgccgagtacagccccttcaagggcggctacaccaagggcctggagggcgagagcctgggctgcagcggcagcgccgccgccggcagcagcggcaccctggagctgcccagcaccctgagcctgtacaagagcggcgccctggacgaggccgccgcctaccagagcagagactactacaacttccccctggccctggccggccccccccccccccccccccccccccacccccacgccagaatcaagctggagaaccccctggactacggcagcgcctgggccgccgccgccgcccagtgcagatacggcgacctggccagcctgcacggcgccggcgccgccggccccggcagcggcagccccagcgccgccgccagcagcagctggcacaccctgttcaccgccgaggagggccagctgtacggcccctgcggcggcggcggcggcggcggcggcggcggcggcggcggcggcggcggcggcggcggcggcggcggcggcgaggccggcgccgtggccccctacggctacaccagacccccccagggcctggccggccaggagagcgacttcaccgcccccgacgtgtggtaccccggcggcatggtgagcagagtgccctaccccagccccacctgcgtgaagagcgagatgggcccctggatggacagctacagcggcccctacggcgacatgagactggagaccgccagagaccacgtgctgcccatcgactactacttccccccccagaagacctgcctgatctgcggcgacgaggccagcggctgccactacggcgccctgacctgcggcagctgcaaggtgttcttcaagagagccgccgagggcaagcagaagtacctgtgcgccagcagaaacgactgcaccatcgacaagttcagaagaaagaactgccccagctgcagactgagaaagtgctacgaggccggcatgaccctgggcgagaagttcagagtgggcaactgcaagcacctgaagatgaccagaccctag

SEQ ID NO: 9333 - DNA, 1803 bp, Artificial Sequence
  Description of Artificial Sequence: Synthetic coding sequence
atggaggtgcagctgggcctgggcagagtgtaccccagaccccccagcaagacctacagaggcgccttccagaacctgttccagagcgtgagagaggtgatccagaaccccggccccagacaccccgaggccgccagcgccgccccccccggcgccagcctgctgctgctgcagcagcagcagcagcagcagcagcagcagcagcagcagcagcagcagcagcagcagcagcagcagcaggagaccagccccagacagcagcagcagcagcagggcgaggacggcagcccccaggcccacagaagaggccccaccggctacctggtgctggacgaggagcagcagcccagccagccccagagcgccctggagtgccaccccgagagaggctgcgtgcccgagcccggcgccgccgtggccgccagcaagggcctgccccagcagctgcccgccccccccgacgaggacgacagcgccgcccccagcaccctgagcctgctgggccccaccttccccggcctgagcagctgcagcgccgacctgaaggacatcctgagcgaggccagcaccatgcagctgctgcagcagcagcagcaggaggccgtgagcgagggcagcagcagcggcagagccagagaggccagcggcgcccccaccagcagcaaggacaactacctgggcggcaccagcaccatcagcgacaacgccaaggagctgtgcaaggccgtgagcgtgagcatgggcctgggcgtggaggccctggagcacctgagccccggcgagcagctgagaggcgactgcatgtacgcccccctgctgggcgtgccccccgccgtgagacccaccccctgcgcccccctggccgagtgcaagggcagcctgctggacgacagcgccggcaagagcaccgaggacaccgccgagtacagccccttcaagggcggctacaccaagggcctggagggcgagagcctgggctgcagcggcagcgccgccgccggcagcagcggcaccctggagctgcccagcaccctgagcctgtacaagagcggcgccctggacgaggccgccgcctaccagagcagagactactacaacttccccctggccctggccggccccccccccccccccccccccccccacccccacgccagaatcaagctggagaaccccctggactacggcagcgcctgggccgccgccgccgcccagtgcagatacggcgacctggccagcctgcacggcgccggcgccgccggccccggcagcggcagccccagcgccgccgccagcagcagctggcacaccctgttcaccgccgaggagggccagctgtacggcccctgcggcggcggcggcggcggcggcggcggcggcggcggcggcggcggcggcggcggcggcggcggcggcggcgaggccggcgccgtggccccctacggctacaccagacccccccagggcctggccggccaggagagcgacttcaccgcccccgacgtgtggtaccccggcggcatggtgagcagagtgccctaccccagccccacctgcgtgaagagcgagatgggcccctggatggacagctacagcggcccctacggcgacatgagactggagaccgccagagaccacgtgctgcccatcgactactacttccccccccagaagacctgcctgatctgcggcgacgaggccagcggctgccactacggcgccctgacctgcggcagctgcaaggtgttcttcaagagagccgccgagggcttcttcagaatgaacaagctgaaggagagctag

SEQ ID NO: 9334 - DNA, 444 bp, Artificial Sequence
  Description of Artificial Sequence: Synthetic coding sequence
atggtgatgggcctgggcgtgctgctgctggtgttcgtgctgggcctgggcctgaccccccccaccctggcccaggacaacagcagatacacccacttcctgacccagcactacgacgccaagccccagggcagagacgacagatactgcgagagcatcatgagaagaagaggcctgaccagcccctgcaaggacatcaacaccttcatccacggcaacaagagaagcatcaaggccatctgcgagaacaagaacggcaacccccacagagagaacctgagaatcagcaagagcagcttccaggtgaccacctgcaagctgcacggcggcagcccctggcccccctgccagtacagagccaccgccggcttcagaaacgtggtggtggcctgcgagaacggcctgcccgtgcacctggaccagagcatcttcagaagaccctag

SEQ ID NO: 9335 - DNA, 444 bp, Artificial Sequence; identical to SEQ ID NO: 9334
  Description of Artificial Sequence: Synthetic coding sequence

SEQ ID NO: 9336 - DNA, 1494 bp, Artificial Sequence
  Description of Artificial Sequence: Synthetic coding sequence
atgaccgtgttcctgagcttcgccttcctggccgccatcctgacccacatcggctgcagcaaccagagaagaagccccgagaacagcggcagaagatacaacagaatccagcacggccagtgcgcctacaccttcatcctgcccgagcacgacggcaactgcagagagagcaccaccgaccagtacaacaccaacgccctgcagagagacgccccccacgtggagcccgacttcagcagccagaagctgcagcacctggagcacgtgatggagaactacacccagtggctgcagaagctggagaactacatcgtggagaacatgaagagcgagatggcccagatccagcagaacgccgtgcagaaccacaccgccaccatgctggagatcggcaccagcctgctgagccagaccgccgagcagaccagaaagctgaccgacgtggagacccaggtgctgaaccagaccagcagactggagatccagctgctggagaacagcctgagcacctacaagctggagaagcagctgctgcagcagaccaacgagatcctgaagatccacgagaagaacagcctgctggagcacaagatcctggagatggagggcaagcacaaggaggagctggacaccctgaaggaggagaaggagaacctgcagggcctggtgaccagacagacctacatcatccaggagctggagaagcagctgaacagagccaccaccaacaacagcgtgctgcagaagcagcagctggagctgatggacaccgtgcacaacctggtgaacctgtgcaccaaggaggtgctgctgaagggcggcaagagagaggaggagaagcccttcagagactgcgccgacgtgtaccaggccggcttcaacaagagcggcatctacaccatctacatcaacaacatgcccgagcccaagaaggtgttctgcaacatggacgtgaacggcggcggctggaccgtgatccagcacagagaggacggcagcctggacttccagagaggctggaaggagtacaagatgggcttcggcaaccccagcggcgagtactggctgggcaacgagttcatcttcgccatcaccagccagagacagtacatgctgagaatcgagctgatggactgggagggcaacagagcctacagccagtacgacagattccacatcggcaacgagaagcagaactacagactgtacctgaagggccacaccggcaccgccggcaagcagagcagcctgatcctgcacggcgccgacttcagcaccaaggacgccgacaacgacaactgcatgtgcaagtgcgccctgatgctgaccggcggctggtggttcgacgcctgcggccccagcaacctgaacggcatgttctacaccgccggccagaaccacggcaagctgaacggcatcaagtggcactacttcaagggccccagctacagcctgagaagcaccaccatgatgatcagacccctggacttctag

SEQ ID NO: 9337 - DNA, 459 bp, Artificial Sequence
  Description of Artificial Sequence: Synthetic coding sequence
accgtgagcaacctgctggagcacaagatcctggagatggagggcaagcacaaggaggagctggacaccctgaaggaggagaaggagaacctgcagggcctggtgaccagacagacctacatcatccaggagctggagaagcagctgaacagagccaccaccaacaacagcgtgctgcagaagcagcagctggagctgatggacaccgtgcacaacctggtgaacctgtgcaccaaggagggcgtgctgctgaagggcggcaagagagaggaggagaagcccttcagagactgcgccgacgtgtaccaggccggcttcaacaagagcggcatctacaccatctacatcaacaacatgcccgagcccaagaaggtgttctgcaacatggacgtgaacggcggcggctggaccgtgatccagcacagagaggacggcagcctggacttccagagaggctag

SEQ ID NO: 9338 - DNA, 1497 bp, Artificial Sequence
  Description of Artificial Sequence: Synthetic coding sequence
atgaccgtgttcctgagcttcgccttcctggccgccatcctgacccacatcggctgcagcaaccagagaagaagccccgagaacagcggcagaagatacaacagaatccagcacggccagtgcgcctacaccttcatcctgcccgagcacgacggcaactgcagagagagcaccaccgaccagtacaacaccaacgccctgcagagagacgccccccacgtggagcccgacttcagcagccagaagctgcagcacctggagcacgtgatggagaactacacccagtggctgcagaagctggagaactacatcgtggagaacatgaagagcgagatggcccagatccagcagaacgccgtgcagaaccacaccgccaccatgctggagatcggcaccagcctgctgagccagaccgccgagcagaccagaaagctgaccgacgtggagacccaggtgctgaaccagaccagcagactggagatccagctgctggagaacagcctgagcacctacaagctggagaagcagctgctgcagcagaccaacgagatcctgaagatccacgagaagaacagcctgctggagcacaagatcctggagatggagggcaagcacaaggaggagctggacaccctgaaggaggagaaggagaacctgcagggcctggtgaccagacagacctacatcatccaggagctggagaagcagctgaacagagccaccaccaacaacagcgtgctgcagaagcagcagctggagctgatggacaccgtgcacaacctggtgaacctgtgcaccaaggagggcgtgctgctgaagggcggcaagagagaggaggagaagcccttcagagactgcgccgacgtgtaccaggccggcttcaacaagagcggcatctacaccatctacatcaacaacatgcccgagcccaagaaggtgttctgcaacatggacgtgaacggcggcggctggaccgtgatccagcacagagaggacggcagcctggacttccagagaggctggaaggagtacaagatgggcttcggcaaccccagcggcgagtactggctgggcaacgagttcatcttcgccatcaccagccagagacagtacatgctgagaatcgagctgatggactgggagggcaacagagcctacagccagtacgacagattccacatcggcaacgagaagcagaactacagactgtacctgaagggccacaccggcaccgccggcaagcagagcagcctgatcctgcacggcgccgacttcagcaccaaggacgccgacaacgacaactgcatgtgcaagtgcgccctgatgctgaccggcggctggtggttcgacgcctgcggccccagcaacctgaacggcatgttctacaccgccggccagaaccacggcaagctgaacggcatcaagtggcactacttcaagggccccagctacagcctgagaagcaccaccatgatgatcagacccctggacttctag

SEQ ID NO: 9339 - DNA, 894 bp, Artificial Sequence
  Description of Artificial Sequence: Synthetic coding sequence
atggagggcaagcacaaggaggagctggacaccctgaaggaggagaaggagaacctgcagggcctggtgaccagacagacctacatcatccaggagctggagaagcagctgaacagagccaccaccaacaacagcgtgctgcagaagcagcagctggagctgatggacaccgtgcacaacctggtgaacctgtgcaccaaggaggtgctgctgaagggcggcaagagagaggaggagaagcccttcagagactgcgccgacgtgtaccaggccggcttcaacaagagcggcatctacaccatctacatcaacaacatgcccgagcccaagaaggtgttctgcaacatggacgtgaacggcggcggctggaccgtgatccagcacagagaggacggcagcctggacttccagagaggctggaaggagtacaagatgggcttcggcaaccccagcggcgagtactggctgggcaacgagttcatcttcgccatcaccagccagagacagtacatgctgagaatcgagctgatggactgggagggcaacagagcctacagccagtacgacagattccacatcggcaacgagaagcagaactacagactgtacctgaagggccacaccggcaccgccggcaagcagagcagcctgatcctgcacggcgccgacttcagcaccaaggacgccgacaacgacaactgcatgtgcaagtgcgccctgatgctgaccggcggctggtggttcgacgcctgcggccccagcaacctgaacggcatgttctacaccgccggccagaaccacggcaagctgaacggcatcaagtggcactacttcaagggccccagctacagcctgagaagcaccaccatgatgatcagacccctggacttctag

SEQ ID NO: 9340 - DNA, 897 bp, Artificial Sequence
  Description of Artificial Sequence: Synthetic coding sequence
atggagggcaagcacaaggaggagctggacaccctgaaggaggagaaggagaacctgcagggcctggtgaccagacagacctacatcatccaggagctggagaagcagctgaacagagccaccaccaacaacagcgtgctgcagaagcagcagctggagctgatggacaccgtgcacaacctggtgaacctgtgcaccaaggagggcgtgctgctgaagggcggcaagagagaggaggagaagcccttcagagactgcgccgacgtgtaccaggccggcttcaacaagagcggcatctacaccatctacatcaacaacatgcccgagcccaagaaggtgttctgcaacatggacgtgaacggcggcggctggaccgtgatccagcacagagaggacggcagcctggacttccagagaggctggaaggagtacaagatgggcttcggcaaccccagcggcgagtactggctgggcaacgagttcatcttcgccatcaccagccagagacagtacatgctgagaatcgagctgatggactgggagggcaacagagcctacagccagtacgacagattccacatcggcaacgagaagcagaactacagactgtacctgaagggccacaccggcaccgccggcaagcagagcagcctgatcctgcacggcgccgacttcagcaccaaggacgccgacaacgacaactgcatgtgcaagtgcgccctgatgctgaccggcggctggtggttcgacgcctgcggccccagcaacctgaacggcatgttctacaccgccggccagaaccacggcaagctgaacggcatcaagtggcactacttcaagggccccagctacagcctgagaagcaccaccatgatgatcagacccctggacttctag

SEQ ID NO: 9341 - DNA, 1491 bp, Artificial Sequence
  Description of Artificial Sequence: Synthetic coding sequence
atgtggcagatcgtgttcttcaccctgagctgcgacctggtgctggccgccgcctacaacaacttcagaaagagcatggacagcatcggcaagaagcagtaccaggtgcagcacggcagctgcagctacaccttcctgctgcccgagatggacaactgcagaagcagcagcagcccctacgtgagcaacgccgtgcagagagacgcccccctggagtacgacgacagcgtgcagagactgcaggtgctggagaacatcatggagaacaacacccagtggctgatgaagctggagaactacatccaggacaacatgaagaaggagatggtggagatccagcagaacgccgtgcagaaccagaccgccgtgatgatcgagatcggcaccaacctgctgaaccagaccgccgagcagaccagaaagctgaccgacgtggaggcccaggtgctgaaccagaccaccagactggagctgcagctgctggagcacagcctgagcaccaacaagctggagaagcagatcctggaccagaccagcgagatcaacaagctgcaggacaagaacagcttcctggagaagaaggtgctggccatggaggacaagcacatcatccagctgcagagcatcaaggaggagaaggaccagctgcaggtgctggtgagcaagcagaacagcatcatcgaggagctggagaagaagatcgtgaccgccaccgtgaacaacagcgtgctgcagaagcagcagcacgacctgatggagaccgtgaacaacctgctgaccatgatgagcaccagcaacagcgccaaggaccccaccgtggccaaggaggagcagatcagcttcagagactgcgccgaggtgttcaagagcggccacaccaccaacggcatctacaccctgaccttccccaacagcaccgaggagatcaaggcctactgcgacatggaggccggcggcggcggctggaccatcatccagagaagagaggacggcagcgtggacttccagagaacctggaaggagtacaaggtgggcttcggcaaccccagcggcgagtactggctgggcaacgagttcgtgagccagctgaccaaccagcagagatacgtgctgaagatccacctgaaggactgggagggcaacgaggcctacagcctgtacgagcacttctacctgagcagcgaggagctgaactacagaatccacctgaagggcctgaccggcaccgccggcaagatcagcagcatcagccagcccggcaacgacttcagcaccaaggacggcgacaacgacaagtgcatctgcaagtgcagccagatgctgaccggcggctggtggttcgacgcctgcggccccagcaacctgaacggcatgtactacccccagagacagaacaccaacaagttcaacggcatcaagtggtactactggaagggcagcggctacagcctgaaggccaccaccatgatgatcagacccgccgacttctag

SEQ ID NO: 9342 - DNA, 1488 bp, Artificial Sequence
  Description of Artificial Sequence: Synthetic coding sequence
atgtggcagatcgtgttcttcaccctgagctgcgacctggtgctggccgccgcctacaacaacttcagaaagagcatggacagcatcggcaagaagcagtaccaggtgcagcacggcagctgcagctacaccttcctgctgcccgagatggacaactgcagaagcagcagcagcccctacgtgagcaacgccgtgcagagagacgcccccctggagtacgacgacagcgtgcagagactgcaggtgctggagaacatcatggagaacaacacccagtggctgatgaagctggagaactacatccaggacaacatgaagaaggagatggtggagatccagcagaacgccgtgcagaaccagaccgccgtgatgatcgagatcggcaccaacctgctgaaccagaccgccgagcagaccagaaagctgaccgacgtggaggcccaggtgctgaaccagaccaccagactggagctgcagctgctggagcacagcctgagcaccaacaagctggagaagcagatcctggaccagaccagcgagatcaacaagctgcaggacaagaacagcttcctggagaagaaggtgctggccatggaggacaagcacatcatccagctgcagagcatcaaggaggagaaggaccagctgcaggtgctggtgagcaagcagaacagcatcatcgaggagctggagaagaagatcgtgaccgccaccgtgaacaacagcgtgctgcagaagcagcagcacgacctgatggagaccgtgaacaacctgctgaccatgatgagcaccagcaacagcaaggaccccaccgtggccaaggaggagcagatcagcttcagagactgcgccgaggtgttcaagagcggccacaccaccaacggcatctacaccctgaccttccccaacagcaccgaggagatcaaggcctactgcgacatggaggccggcggcggcggctggaccatcatccagagaagagaggacggcagcgtggacttccagagaacctggaaggagtacaaggtgggcttcggcaaccccagcggcgagtactggctgggcaacgagttcgtgagccagctgaccaaccagcagagatacgtgctgaagatccacctgaaggactgggagggcaacgaggcctacagcctgtacgagcacttctacctgagcagcgaggagctgaactacagaatccacctgaagggcctgaccggcaccgccggcaagatcagcagcatcagccagcccggcaacgacttcagcaccaaggacggcgacaacgacaagtgcatctgcaagtgcagccagatgctgaccggcggctggtggttcgacgcctgcggccccagcaacctgaacggcatgtactacccccagagacagaacaccaacaagttcaacggcatcaagtggtactactggaagggcagcggctacagcctgaaggccaccaccatgatgatcagacccgccgacttctag

SEQ ID NO: 9343 - DNA, 1335 bp, Artificial Sequence
  Description of Artificial Sequence: Synthetic coding sequence
atgtggcagatcgtgttcttcaccctgagctgcgacctggtgctggccgccgcctacaacaacttcagaaagagcatggacagcatcggcaagaagcagtaccaggtgcagcacggcagctgcagctacaccttcctgctgcccgagatggacaactgcagaagcagcagcagcccctacgtgagcaacgccgtgcagagagacgcccccctggagtacgacgacagcgtgcagagactgcaggtgctggagaacatcatggagaacaacacccagtggctgatgaaggtgctgaaccagaccaccagactggagctgcagctgctggagcacagcctgagcaccaacaagctggagaagcagatcctggaccagaccagcgagatcaacaagctgcaggacaagaacagcttcctggagaagaaggtgctggccatggaggacaagcacatcatccagctgcagagcatcaaggaggagaaggaccagctgcaggtgctggtgagcaagcagaacagcatcatcgaggagctggagaagaagatcgtgaccgccaccgtgaacaacagcgtgctgcagaagcagcagcacgacctgatggagaccgtgaacaacctgctgaccatgatgagcaccagcaacagcgccaaggaccccaccgtggccaaggaggagcagatcagcttcagagactgcgccgaggtgttcaagagcggccacaccaccaacggcatctacaccctgaccttccccaacagcaccgaggagatcaaggcctactgcgacatggaggccggcggcggcggctggaccatcatccagagaagagaggacggcagcgtggacttccagagaacctggaaggagtacaaggtgggcttcggcaaccccagcggcgagtactggctgggcaacgagttcgtgagccagctgaccaaccagcagagatacgtgctgaagatccacctgaaggactgggagggcaacgaggcctacagcctgtacgagcacttctacctgagcagcgaggagctgaactacagaatccacctgaagggcctgaccggcaccgccggcaagatcagcagcatcagccagcccggcaacgacttcagcaccaaggacggcgacaacgacaagtgcatctgcaagtgcagccagatgctgaccggcggctggtggttcgacgcctgcggccccagcaacctgaacggcatgtactacccccagagacagaacaccaacaagttcaacggcatcaagtggtactactggaagggcagcggctacagcctgaaggccaccaccatgatgatcagacccgccgacttctag

SEQ ID NO: 9344 - DNA, 1221 bp, Artificial Sequence
  Description of Artificial Sequence: Synthetic coding sequence
atgagcggcgcccccaccgccggcgccgccctgatgctgtgcgccgccaccgccgtgctgctgagcgcccagggcggccccgtgcagagcaagagccccagattcgccagctgggacgagatgaacgtgctggcccacggcctgctgcagctgggccagggcctgagagagcacgccgagagaaccagaagccagctgagcgccctggagagaagactgagcgcctgcggcagcgcctgccagggcaccgagggcagcaccgacctgcccctggcccccgagagcagagtggaccccgaggtgctgcacagcctgcagacccagctgaaggcccagaacagcagaatccagcagctgttccacaaggtggcccagcagcagagacacctggagaagcagcacctgagaatccagcacctgcagagccagttcggcctgctggaccacaagcacctggaccacgaggtggccaagcccgccagaagaaagagactgcccgagatggcccagcccgtggaccccgcccacaacgtgagcagactgcacagactgcccagagactgccaggagctgttccaggtgggcgagagacagagcggcctgttcgagatccagccccagggcagcccccccttcctggtgaactgcaagatgaccagcgacggcggctggaccgtgatccagagaagacacgacggcagcgtggacttcaacagaccctgggaggcctacaaggccggcttcggcgacccccacggcgagttctggctgggcctggagaaggtgcacagcatcaccggcgacagaaacagcagactggccgtgcagctgagagactgggacggcaacgccgagctgctgcagttcagcgtgcacctgggcggcgaggacaccgcctacagcctgcagctgaccgcccccgtggccggccagctgggcgccaccaccgtgccccccagcggcctgagcgtgcccttcagcacctgggaccaggaccacgacctgagaagagacaagaactgcgccaagagcctgagcggcggctggtggttcggcacctgcagccacagcaacctgaacggccagtacttcagaagcatcccccagcagagacagaagctgaagaagggcatcttctggaagacctggagaggcagatactaccccctgcaggccaccaccatgctgatccagcccatggccgccgaggccgccagctag

SEQ ID NO: 9345 - DNA, 1107 bp, Artificial Sequence
  Description of Artificial Sequence: Synthetic coding sequence
atgagcggcgcccccaccgccggcgccgccctgatgctgtgcgccgccaccgccgtgctgctgagcgcccagggcggccccgtgcagagcaagagccccagattcgccagctgggacgagatgaacgtgctggcccacggcctgctgcagctgggccagggcctgagagagcacgccgagagaaccagaagccagctgagcgccctggagagaagactgagcgcctgcggcagcgcctgccagggcaccgagggcagcaccgacctgcccctggcccccgagagcagagtggaccccgaggtgctgcacagcctgcagacccagctgaaggcccagaacagcagaatccagcagctgttccacaaggtggcccagcagcagagacacctggagaagcagcacctgagaatccagcacctgcagagccagttcggcctgctggaccacaagcacctggaccacgaggtggccaagcccgccagaagaaagagactgcccgagatggcccagcccgtggaccccgcccacaacgtgagcagactgcaccacggcggctggaccgtgatccagagaagacacgacggcagcgtggacttcaacagaccctgggaggcctacaaggccggcttcggcgacccccacggcgagttctggctgggcctggagaaggtgcacagcatcaccggcgacagaaacagcagactggccgtgcagctgagagactgggacggcaacgccgagctgctgcagttcagcgtgcacctgggcggcgaggacaccgcctacagcctgcagctgaccgcccccgtggccggccagctgggcgccaccaccgtgccccccagcggcctgagcgtgcccttcagcacctgggaccaggaccacgacctgagaagagacaagaactgcgccaagagcctgagcggcggctggtggttcggcacctgcagccacagcaacctgaacggccagtacttcagaagcatcccccagcagagacagaagctgaagaagggcatcttctggaagacctggagaggcagatactaccccctgcaggccaccaccatgctgatccagcccatggccgccgaggccgccagctag

SEQ ID NO: 9346 - DNA, 720 bp, Artificial Sequence
  Description of Artificial Sequence: Synthetic coding sequence
atggcccagcccgtggaccccgcccacaacgtgagcagactgcacagactgcccagagactgccaggagctgttccaggtgggcgagagacagagcggcctgttcgagatccagccccagggcagcccccccttcctggtgaactgcaagatgaccagcgacggcggctggaccgtgatccagagaagacacgacggcagcgtggacttcaacagaccctgggaggcctacaaggccggcttcggcgacccccacggcgagttctggctgggcctggagaaggtgcacagcatcaccggcgacagaaacagcagactggccgtgcagctgagagactgggacggcaacgccgagctgctgcagttcagcgtgcacctgggcggcgaggacaccgcctacagcctgcagctgaccgcccccgtggccggccagctgggcgccaccaccgtgccccccagcggcctgagcgtgcccttcagcacctgggaccaggaccacgacctgagaagagacaagaactgcgccaagagcctgagcggcggctggtggttcggcacctgcagccacagcaacctgaacggccagtacttcagaagcatcccccagcagagacagaagctgaagaagggcatcttctggaagacctggagaggcagatactaccccctgcaggccaccaccatgctgatccagcccatggccgccgaggccgccagctag

SEQ ID NO: 9347 - DNA, 837 bp, Artificial Sequence
  Description of Artificial Sequence: Synthetic coding sequence
atggagcccagagccgccgacggctgcttcctgggcgacgtgggcttctgggtggagagaacccccgtgcacgaggccgcccagagaggcgagagcctgcagctgcagcagctgatcgagagcggcgcctgcgtgaaccaggtgaccgtggacagcatcacccccctgcacgccgccagcctgcagggccaggccagatgcgtgcagctgctgctggccgccggcgcccaggtggacgccagaaacatcgacggcagcacccccctgtgcgacgcctgcgccagcggcagcatcgagtgcgtgaagctgctgctgagctacggcgccaaggtgaacccccccctgtacaccgccagccccctgcacgaggcctgcatgagcggcagcagcgagtgcgtgagactgctgatcgacgtgggcgccaacctggaggcccacgactgccacttcggcacccccctgcacgtggcctgcgccagagagcacctggactgcgtgaaggtgctgctgaacgccggcgccaacgtgaacgccgccaagctgcacgagaccgccctgcaccacgccgccaaggtgaagaacgtggacctgatcgagatgctgatcgagttcggcggcaacatctacgccagagacaacagaggcaagaagcccagcgactacacctggagcagcagcgcccccgccaagtgcttcgagtactacgagaagacccccctgaccctgagccagctgtgcagagtgaacctgagaaaggccaccggcgtgagaggcctggagaagatcgccaagctgaacatcccccccagactgatcgactacctgagctacaactag

SEQ ID NO: 9348 - DNA, 396 bp, Artificial Sequence
  Description of Artificial Sequence: Synthetic coding sequence
atggagaagatccccgtgagcgccttcctgctgctggtggccctgagctacaccctggccagagacaccaccgtgaagcccggcgccaagaaggacaccaaggacagcagacccaagctgccccagaccctgagcagaggctggggcgaccagctgatctggacccagacctacgaggaggccctgtacaagagcaagaccagcaacaagcccctgatgatcatccaccacctggacgagtgcccccacagccaggccctgaagaaggtgttcgccgagaacaaggagatccagaagctggccgagcagttcgtgctgctgaacctggtgtacgagaccaccgacaagcacctgagccccgacggccagtacgtgcccagaatcatgttcgtgtag

SEQ ID NO: 9349 - DNA, 528 bp, Artificial Sequence
  Description of Artificial Sequence: Synthetic coding sequence
atggagaagatccccgtgagcgccttcctgctgctggtggccctgagctacaccctggccagagacaccaccgtgaagcccggcgccaagaaggacaccaaggacagcagacccaagctgccccagaccctgagcagaggctggggcgaccagctgatctggacccagacctacgaggaggccctgtacaagagcaagaccagcaacaagcccctgatgatcatccaccacctggacgagtgcccccacagccaggccctgaagaaggtgttcgccgagaacaaggagatccagaagctggccgagcagttcgtgctgctgaacctggtgtacgagaccaccgacaagcacctgagccccgacggccagtacgtgcccagaatcatgttcgtggaccccagcctgaccgtgagagccgacatcaccggcagatacagcaacagactgtacgcctacgagcccgccgacaccgccctgctgctggacaacatgaagaaggccctgaagctgctgaagaccgagctgtag

SEQ ID NO: 9350 - DNA, 588 bp, Artificial Sequence
  Description of Artificial Sequence: Synthetic coding sequence
atgagcaactacaccgacgccgagagcagcttcagcaagcaggagatcatcagagtggccatggagaagatccccgtgagcgccttcctgctgctggtggccctgagctacaccctggccagagacaccaccgtgaagcccggcgccaagaaggacaccaaggacagcagacccaagctgccccagaccctgagcagaggctggggcgaccagctgatctggacccagacctacgaggaggccctgtacaagagcaagaccagcaacaagcccctgatgatcatccaccacctggacgagtgcccccacagccaggccctgaagaaggtgttcgccgagaacaaggagatccagaagctggccgagcagttcgtgctgctgaacctggtgtacgagaccaccgacaagcacctgagccccgacggccagtacgtgcccagaatcatgttcgtggaccccagcctgaccgtgagagccgacatcaccggcagatacagcaacagactgtacgcctacgagcccgccgacaccgccctgctgctggacaacatgaagaaggccctgaagctgctgaagaccgagctgtag

SEQ ID NO: 9351 - DNA, 1251 bp, Artificial Sequence
  Description of Artificial Sequence: Synthetic coding sequence
atgtggcccaccagaagactggtgaccatcaagagaagcggcgtggacggcccccacttccccctgagcctgagcacctgcctgttcggcagatacgagaacgagagcctgcagaacggcagaaagagcaccgagttccccagaaagatcagagagcaggagcccgccagaagagtgagcagaagcagcttcagcagcgaccccgacgagagcgagggcatccccctgaagagaagaagagtgagcttcggcggccacctgagacccgagctgttcgacgagaacctgccccccaacacccccctgaagagaggcgaggcccccaccaagagaaagagcctggtgatgcacaccccccccgtgctgaagaagatcatcaaggagcagccccagcccagcggcaagcaggagagcggcagcgagatccacgtggaggtgaaggcccagagcctggtgatcagcccccccgcccccagccccagaaagacccccgtggccagcgaccagagaagaagaagctgcaagaccgcccccgccagcagcagcaagagccagaccgaggtgcccaagagaggcggcagaaagagcggcaacctgcccagcaagagagtgagcatcagcagaagccagcacgacatcctgcagatgatctgcagcaagagaagaagcggcgccagcgaggccaacctgatcgtggccaagagctgggccgacgtggtgaagctgggcgccaagcagacccagaccaaggtgatcaagcacggcccccagagaagcatgaacaagagacagagaagacccgccacccccaagaagcccgtgggcgaggtgcacagccagttcagcaccggccacgccaacagcccctgcaccatcatcatcggcaaggcccacaccgagaaggtgcacgtgcccgccagaccctacagagtgctgaacaacttcatcagcaaccagaagatggacttcaaggaggacctgagcggcatcgccgagatgttcaagacccccgtgaaggagcagccccagctgaccagcacctgccacatcgccatcagcaacagcgagaacctgctgggcaagcagttccagggcaccgacagcggcgaggagcccctgctgcccaccagcgagagcttcggcggcaacgtgttcttcagcgcccagaacgccgccaagcagcccagcgacaagtgcagcgccagcccccccctgagaagacagtgcatcagagagaacggcaacgtgtag

SEQ ID NO: 9352 - DNA, 8691 bp, Artificial Sequence
  Description of Artificial Sequence: Synthetic coding sequence
atgtggcccaccagaagactggtgaccatcaagagaagcggcgtggacggcccccacttccccctgagcctgagcacctgcctgttcggcagaggcatcgagtgcgacatcagaatccagctgcccgtggtgagcaagcagcactgcaagatcgagatccacgagcaggaggccatcctgcacaacttcagcagcaccaaccccacccaggtgaacggcagcgtgatcgacgagcccgtgagactgaagcacggcgacgtgatcaccatcatcgacagaagcttcagatacgagaacgagagcctgcagaacggcagaaagagcaccgagttccccagaaagatcagagagcaggagcccgccagaagagtgagcagaagcagcttcagcagcgaccccgacgagagcgagggcatccccctgaagagaagaagagtgagcttcggcggccacctgagacccgagctgttcgacgagaacctgccccccaacacccccctgaagagaggcgaggcccccaccaagagaaagagcctggtgatgcacaccccccccgtgctgaagaagatcatcaaggagcagccccagcccagcggcaagcaggagagcggcagcgagatccacgtggaggtgaaggcccagagcctggtgatcagcccccccgcccccagccccagaaagacccccgtggccagcgaccagagaagaagaagctgcaagaccgcccccgccagcagcagcaagagccagaccgaggtgcccaagagaggcggcagaaagagcggcaacctgcccagcaagagagtgagcatcagcagaagccagcacgacatcctgcagatgatctgcagcaagagaagaagcggcgccagcgaggccaacctgatcgtggccaagagctgggccgacgtggtgaagctgggcgccaagcagacccagaccaaggtgatcaagcacggcccccagagaagcatgaacaagagacagagaagacccgccacccccaagaagcccgtgggcgaggtgcacagccagttcagcaccggccacgccaacagcccctgcaccatcatcatcggcaaggcccacaccgagaaggtgcacgtgcccgccagaccctacagagtgctgaacaacttcatcagcaaccagaagatggacttcaaggaggacctgagcggcatcgccgagatgttcaagacccccgtgaaggagcagccccagctgaccagcacctgccacatcgccatcagcaacagcgagaacctgctgggcaagcagttccagggcaccgacagcggcgaggagcccctgctgcccaccagcgagagcttcggcggcaacgtgttcttcagcgcccagaacgccgccaagcagcccagcgacaagtgcagcgccagcccccccctgagaagacagtgcatcagagagaacggcaacgtggccaagacccccagaaacacctacaagatgaccagcctggagaccaagaccagcgacaccgagaccgagcccagcaagaccgtgagcaccgccaacagaagcggcagaagcaccgagttcagaaacatccagaagctgcccgtggagagcaagagcgaggagaccaacaccgagatcgtggagtgcatcctgaagagaggccagaaggccaccctgctgcagcagagaagagagggcgagatgaaggagatcgagagacccttcgagacctacaaggagaacatcgagctgaaggagaacgacgagaagatgaaggccatgaagagaagcagaacctggggccagaagtgcgcccccatgagcgacctgaccgacctgaagagcctgcccgacaccgagctgatgaaggacaccgccagaggccagaacctgctgcagacccaggaccacgccaaggcccccaagagcgagaagggcaagatcaccaagatgccctgccagagcctgcagcccgagcccatcaacacccccacccacaccaagcagcagctgaaggccagcctgggcaaggtgggcgtgaaggaggagctgctggccgtgggcaagttcaccagaaccagcggcgagaccacccacacccacagagagcccgccggcgacggcaagagcatcagaaccttcaaggagagccccaagcagatcctggaccccgccgccagagtgaccggcatgaagaagtggcccagaacccccaaggaggaggcccagagcctggaggacctggccggcttcaaggagctgttccagacccccggccccagcgaggagagcatgaccgacgagaagaccaccaagatcgcctgcaagagccccccccccgagagcgtggacacccccaccagcaccaagcagtggcccaagagaagcctgagaaaggccgacgtggaggaggagttcctggccctgagaaagctgacccccagcgccggcaaggccatgctgacccccaagcccgccggcggcgacgagaaggacatcaaggccttcatgggcacccccgtgcagaagctggacctggccggcaccctgcccggcagcaagagacagctgcagacccccaaggagaaggcccaggccctggaggacctggccggcttcaaggagctgttccagacccccggccacaccgaggagctggtggccgccggcaagaccaccaagatcccctgcgacagcccccagagcgaccccgtggacacccccaccagcaccaagcagagacccaagagaagcatcagaaaggccgacgtggagggcgagctgctggcctgcagaaacctgatgcccagcgccggcaaggccatgcacacccccaagcccagcgtgggcgaggagaaggacatcatcatcttcgtgggcacccccgtgcagaagctggacctgaccgagaacctgaccggcagcaagagaagaccccagacccccaaggaggaggcccaggccctggaggacctgaccggcttcaaggagctgttccagacccccggccacaccgaggaggccgtggccgccggcaagaccaccaagatgccctgcgagagcagcccccccgagagcgccgacacccccaccagcaccagaagacagcccaagacccccctggagaagagagacgtgcagaaggagctgagcgccctgaagaagctgacccagaccagcggcgagaccacccacaccgacaaggtgcccggcggcgaggacaagagcatcaacgccttcagagagaccgccaagcagaagctggaccccgccgccagcgtgaccggcagcaagagacaccccaagaccaaggagaaggcccagcccctggaggacctggccggcctgaaggagctgttccagacccccgtgtgcaccgacaagcccaccacccacgagaagaccaccaagatcgcctgcagaagccagcccgaccccgtggacacccccaccagcagcaagccccagagcaagagaagcctgagaaaggtggacgtggaggaggagttcttcgccctgagaaagagaacccccagcgccggcaaggccatgcacacccccaagcccgccgtgagcggcgagaagaacatctacgccttcatgggcacccccgtgcagaagctggacctgaccgagaacctgaccggcagcaagagaagactgcagacccccaaggagaaggcccaggccctggaggacctggccggcttcaaggagctgttccagaccagaggccacaccgaggagagcatgaccaacgacaagaccgccaaggtggcctgcaagagcagccagcccgaccccgacaagaaccccgccagcagcaagagaagactgaagaccagcctgggcaaggtgggcgtgaaggaggagctgctggccgtgggcaagctgacccagaccagcggcgagaccacccacacccacaccgagcccaccggcgacggcaagagcatgaaggccttcatggagagccccaagcagatcctggacagcgccgccagcctgaccggcagcaagagacagctgagaacccccaagggcaagagcgaggtgcccgaggacctggccggcttcatcgagctgttccagacccccagccacaccaaggagagcatgaccaacgagaagaccaccaaggtgagctacagagccagccagcccgacctggtggacacccccaccagcagcaagccccagcccaagagaagcctgagaaaggccgacaccgaggaggagttcctggccttcagaaagcagacccccagcgccggcaaggccatgcacacccccaagcccgccgtgggcgaggagaaggacatcaacaccttcctgggcacccccgtgcagaagctggaccagcccggcaacctgcccggcagcaacagaagactgcagaccagaaaggagaaggcccaggccctggaggagctgaccggcttcagagagctgttccagaccccctgcaccgacaaccccaccaccgacgagaagaccaccaagaagatcctgtgcaagagcccccagagcgaccccgccgacacccccaccaacaccaagcagagacccaagagaagcctgaagaaggccgacgtggaggaggagttcctggccttcagaaagctgacccccagcgccggcaaggccatgcacacccccaaggccgccgtgggcgaggagaaggacatcaacaccttcgtgggcacccccgtggagaagctggacctgctgggcaacctgcccggcagcaagagaagaccccagacccccaaggagaaggccaaggccctggaggacctggccggcttcaaggagctgttccagacccccggccacaccgaggagagcatgaccgacgacaagatcaccgaggtgagctgcaagagcccccagcccgaccccgtgaagacccccaccagcagcaagcagagactgaagatcagcctgggcaaggtgggcgtgaaggaggaggtgctgcccgtgggcaagctgacccagaccagcggcaagaccacccagacccacagagagaccgccggcgacggcaagagcatcaaggccttcaaggagagcgccaagcagatgctggaccccgccaactacggcaccggcatggagagatggcccagaacccccaaggaggaggcccagagcctggaggacctggccggcttcaaggagctgttccagacccccgaccacaccgaggagagcaccaccgacgacaagaccaccaagatcgcctgcaagagccccccccccgagagcatggacacccccaccagcaccagaagaagacccaagacccccctgggcaagagagacatcgtggaggagctgagcgccctgaagcagctgacccagaccacccacaccgacaaggtgcccggcgacgaggacaagggcatcaacgtgttcagagagaccgccaagcagaagctggaccccgccgccagcgtgaccggcagcaagagacagcccagaacccccaagggcaaggcccagcccctggaggacctggccggcctgaaggagctgttccagacccccatctgcaccgacaagcccaccacccacgagaagaccaccaagatcgcctgcagaagcccccagcccgaccccgtgggcacccccaccatcttcaagccccagagcaagagaagcctgagaaaggccgacgtggaggaggagagcctggccctgagaaagagaacccccagcgtgggcaaggccatggacacccccaagcccgccggcggcgacgagaaggacatgaaggccttcatgggcacccccgtgcagaagctggacctgcccggcaacctgcccggcagcaagagatggccccagacccccaaggagaaggcccaggccctggaggacctggccggcttcaaggagctgttccagacccccggcaccgacaagcccaccaccgacgagaagaccaccaagatcgcctgcaagagcccccagcccgaccccgtggacacccccgccagcaccaagcagagacccaagagaaacctgagaaaggccgacgtggaggaggagttcctggccctgagaaagagaacccccagcgccggcaaggccatggacacccccaagcccgccgtgagcgacgagaagaacatcaacaccttcgtggagacccccgtgcagaagctggacctgctgggcaacctgcccggcagcaagagacagccccagacccccaaggagaaggccgaggccctggaggacctggtgggcttcaaggagctgttccagacccccggccacaccgaggagagcatgaccgacgacaagatcaccgaggtgagctgcaagagcccccagcccgagagcttcaagaccagcagaagcagcaagcagagactgaagatccccctggtgaaggtggacatgaaggaggagcccctggccgtgagcaagctgaccagaaccagcggcgagaccacccagacccacaccgagcccaccggcgacagcaagagcatcaaggccttcaaggagagccccaagcagatcctggaccccgccgccagcgtgaccggcagcagaagacagctgagaaccagaaaggagaaggccagagccctggaggacctggtggacttcaaggagctgttcagcgcccccggccacaccgaggagagcatgaccatcgacaagaacaccaagatcccctgcaagagccccccccccgagctgaccgacaccgccaccagcaccaagagatgccccaagaccagacccagaaaggaggtgaaggaggagctgagcgccgtggagagactgacccagaccagcggccagagcacccacacccacaaggagcccgccagcggcgacgagggcatcaaggtgctgaagcagagagccaagaagaagcccaaccccgtggaggaggagcccagcagaagaagacccagagcccccaaggagaaggcccagcccctggaggacctggccggcttcaccgagctgagcgagaccagcggccacacccaggagagcctgaccgccggcaaggccaccaagatcccctgcgagagcccccccctggaggtggtggacaccaccgccagcaccaagagacacctgagaaccagagtgcagaaggtgcaggtgaaggaggagcccagcgccgtgaagttcacccagaccagcggcgagaccaccgacgccgacaaggagcccgccggcgaggacaagggcatcaaggccctgaaggagagcgccaagcagacccccgcccccgccgccagcgtgaccggcagcagaagaagacccagagcccccagagagagcgcccaggccatcgaggacctggccggcttcaaggaccccgccgccggccacaccgaggagagcatgaccgacgacaagaccaccaagatcccctgcaagagcagccccgagctggaggacaccgccaccagcagcaagagaagacccagaaccagagcccagaaggtggaggtgaaggaggagctgctggccgtgggcaagctgacccagaccagcggcgagaccacccacaccgacaaggagcccgtgggcgagggcaagggcaccaaggccttcaagcagcccgccaagagaaagctggacgccgaggacgtgatcggcagcagaagacagcccagagcccccaaggagaaggcccagcccctggaggacctggccagcttccaggagctgagccagacccccggccacaccgaggagctggccaacggcgccgccgacagcttcaccagcgcccccaagcagacccccgacagcggcaagcccctgaagatcagcagaagagtgctgagagcccccaaggtggagcccgtgggcgacgtggtgagcaccagagaccccgtgaagagccagagcaagagcaacaccagcctgccccccctgcccttcaagagaggcggcggcaaggacggcagcgtgaccggcaccaagagactgagatgcatgcccgcccccgaggagatcgtggaggagctgcccgccagcaagaagcagagagtggcccccagagccagaggcaagagcagcgagcccgtggtgatcatgaagagaagcctgagaaccagcgccaagagaatcgagcccgccgaggagctgaacagcaacgacatgaagaccaacaaggaggagcacaagctgcaggacagcgtgcccgagaacaagggcatcagcctgagaagcagaagacagaacaagaccgaggccgagcagcagatcaccgaggtgttcgtgctggccgagagaatcgagatcaacagaaacgagaagaagcccatgaagaccagccccgagatggacatccagaaccccgacgacggcgccagaaagcccatccccagagacaaggtgaccgagaacaagagatgcctgagaagcgccagacagaacgagagcagccagcccaaggtggccgaggagagcggcggccagaagagcgccaaggtgctgatgcagaaccagaagggcaagggcgaggccggcaacagcgacagcatgtgcctgagaagcagaaagaccaagagccagcccgccgccagcaccctggagagcaagagcgtgcagagagtgaccagaagcgtgaagagatgcgccgagaaccccaagaaggccgaggacaacgtgtgcgtgaagaagatcagaaccagaagccacagagacagcgaggacatctag

SEQ ID NO: 9353 - DNA, 9771 bp, Artificial Sequence
  Description of Artificial Sequence: Synthetic coding sequence
atgtggcccaccagaagactggtgaccatcaagagaagcggcgtggacggcccccacttccccctgagcctgagcacctgcctgttcggcagaggcatcgagtgcgacatcagaatccagctgcccgtggtgagcaagcagcactgcaagatcgagatccacgagcaggaggccatcctgcacaacttcagcagcaccaaccccacccaggtgaacggcagcgtgatcgacgagcccgtgagactgaagcacggcgacgtgatcaccatcatcgacagaagcttcagatacgagaacgagagcctgcagaacggcagaaagagcaccgagttccccagaaagatcagagagcaggagcccgccagaagagtgagcagaagcagcttcagcagcgaccccgacgagaaggcccaggacagcaaggcctacagcaagatcaccgagggcaaggtgagcggcaacccccaggtgcacatcaagaacgtgaaggaggacagcaccgccgacgacagcaaggacagcgtggcccagggcaccaccaacgtgcacagcagcgagcacgccggcagaaacggcagaaacgccgccgaccccatcagcggcgacttcaaggagatcagcagcgtgaagctggtgagcagatacggcgagctgaagagcgtgcccaccacccagtgcctggacaacagcaagaagaacgagagccccttctggaagctgtacgagagcgtgaagaaggagctggacgtgaagagccagaaggagaacgtgctgcagtactgcagaaagagcggcctgcagaccgactacgccaccgagaaggagagcgccgacggcctgcagggcgagacccagctgctggtgagcagaaagagcagacccaagagcggcggcagcggccacgccgtggccgagcccgccagccccgagcaggagctggaccagaacaagggcaagggcagagacgtggagagcgtgcagacccccagcaaggccgtgggcgccagcttccccctgtacgagcccgccaagatgaagacccccgtgcagtacagccagcagcagaacagcccccagaagcacaagaacaaggacctgtacaccaccggcagaagagagagcgtgaacctgggcaagagcgagggcttcaaggccggcgacaagaccctgacccccagaaagctgagcaccagaaacagaacccccgccaaggtggaggacgccgccgacagcgccaccaagcccgagaacctgagcagcaagaccagaggcagcatccccaccgacgtggaggtgctgcccaccgagaccgagatccacaacgagcccttcctgaccctgtggctgacccaggtggagagaaagatccagaaggacagcctgagcaagcccgagaagctgggcaccaccgccggccagatgtgcagcggcctgcccggcctgagcagcgtggacatcaacaacttcggcgacagcatcaacgagagcgagggcatccccctgaagagaagaagagtgagcttcggcggccacctgagacccgagctgttcgacgagaacctgccccccaacacccccctgaagagaggcgaggcccccaccaagagaaagagcctggtgatgcacaccccccccgtgctgaagaagatcatcaaggagcagccccagcccagcggcaagcaggagagcggcagcgagatccacgtggaggtgaaggcccagagcctggtgatcagcccccccgcccccagccccagaaagacccccgtggccagcgaccagagaagaagaagctgcaagaccgcccccgccagcagcagcaagagccagaccgaggtgcccaagagaggcggcagaaagagcggcaacctgcccagcaagagagtgagcatcagcagaagccagcacgacatcctgcagatgatctgcagcaagagaagaagcggcgccagcgaggccaacctgatcgtggccaagagctgggccgacgtggtgaagctgggcgccaagcagacccagaccaaggtgatcaagcacggcccccagagaagcatgaacaagagacagagaagacccgccacccccaagaagcccgtgggcgaggtgcacagccagttcagcaccggccacgccaacagcccctgcaccatcatcatcggcaaggcccacaccgagaaggtgcacgtgcccgccagaccctacagagtgctgaacaacttcatcagcaaccagaagatggacttcaaggaggacctgagcggcatcgccgagatgttcaagacccccgtgaaggagcagccccagctgaccagcacctgccacatcgccatcagcaacagcgagaacctgctgggcaagcagttccagggcaccgacagcggcgaggagcccctgctgcccaccagcgagagcttcggcggcaacgtgttcttcagcgcccagaacgccgccaagcagcccagcgacaagtgcagcgccagcccccccctgagaagacagtgcatcagagagaacggcaacgtggccaagacccccagaaacacctacaagatgaccagcctggagaccaagaccagcgacaccgagaccgagcccagcaagaccgtgagcaccgccaacagaagcggcagaagcaccgagttcagaaacatccagaagctgcccgtggagagcaagagcgaggagaccaacaccgagatcgtggagtgcatcctgaagagaggccagaaggccaccctgctgcagcagagaagagagggcgagatgaaggagatcgagagacccttcgagacctacaaggagaacatcgagctgaaggagaacgacgagaagatgaaggccatgaagagaagcagaacctggggccagaagtgcgcccccatgagcgacctgaccgacctgaagagcctgcccgacaccgagctgatgaaggacaccgccagaggccagaacctgctgcagacccaggaccacgccaaggcccccaagagcgagaagggcaagatcaccaagatgccctgccagagcctgcagcccgagcccatcaacacccccacccacaccaagcagcagctgaaggccagcctgggcaaggtgggcgtgaaggaggagctgctggccgtgggcaagttcaccagaaccagcggcgagaccacccacacccacagagagcccgccggcgacggcaagagcatcagaaccttcaaggagagccccaagcagatcctggaccccgccgccagagtgaccggcatgaagaagtggcccagaacccccaaggaggaggcccagagcctggaggacctggccggcttcaaggagctgttccagacccccggccccagcgaggagagcatgaccgacgagaagaccaccaagatcgcctgcaagagccccccccccgagagcgtggacacccccaccagcaccaagcagtggcccaagagaagcctgagaaaggccgacgtggaggaggagttcctggccctgagaaagctgacccccagcgccggcaaggccatgctgacccccaagcccgccggcggcgacgagaaggacatcaaggccttcatgggcacccccgtgcagaagctggacctggccggcaccctgcccggcagcaagagacagctgcagacccccaaggagaaggcccaggccctggaggacctggccggcttcaaggagctgttccagacccccggccacaccgaggagctggtggccgccggcaagaccaccaagatcccctgcgacagcccccagagcgaccccgtggacacccccaccagcaccaagcagagacccaagagaagcatcagaaaggccgacgtggagggcgagctgctggcctgcagaaacctgatgcccagcgccggcaaggccatgcacacccccaagcccagcgtgggcgaggagaaggacatcatcatcttcgtgggcacccccgtgcagaagctggacctgaccgagaacctgaccggcagcaagagaagaccccagacccccaaggaggaggcccaggccctggaggacctgaccggcttcaaggagctgttccagacccccggccacaccgaggaggccgtggccgccggcaagaccaccaagatgccctgcgagagcagcccccccgagagcgccgacacccccaccagcaccagaagacagcccaagacccccctggagaagagagacgtgcagaaggagctgagcgccctgaagaagctgacccagaccagcggcgagaccacccacaccgacaaggtgcccggcggcgaggacaagagcatcaacgccttcagagagaccgccaagcagaagctggaccccgccgccagcgtgaccggcagcaagagacaccccaagaccaaggagaaggcccagcccctggaggacctggccggcctgaaggagctgttccagacccccgtgtgcaccgacaagcccaccacccacgagaagaccaccaagatcgcctgcagaagccagcccgaccccgtggacacccccaccagcagcaagccccagagcaagagaagcctgagaaaggtggacgtggaggaggagttcttcgccctgagaaagagaacccccagcgccggcaaggccatgcacacccccaagcccgccgtgagcggcgagaagaacatctacgccttcatgggcacccccgtgcagaagctggacctgaccgagaacctgaccggcagcaagagaagactgcagacccccaaggagaaggcccaggccctggaggacctggccggcttcaaggagctgttccagaccagaggccacaccgaggagagcatgaccaacgacaagaccgccaaggtggcctgcaagagcagccagcccgaccccgacaagaaccccgccagcagcaagagaagactgaagaccagcctgggcaaggtgggcgtgaaggaggagctgctggccgtgggcaagctgacccagaccagcggcgagaccacccacacccacaccgagcccaccggcgacggcaagagcatgaaggccttcatggagagccccaagcagatcctggacagcgccgccagcctgaccggcagcaagagacagctgagaacccccaagggcaagagcgaggtgcccgaggacctggccggcttcatcgagctgttccagacccccagccacaccaaggagagcatgaccaacgagaagaccaccaaggtgagctacagagccagccagcccgacctggtggacacccccaccagcagcaagccccagcccaagagaagcctgagaaaggccgacaccgaggaggagttcctggccttcagaaagcagacccccagcgccggcaaggccatgcacacccccaagcccgccgtgggcgaggagaaggacatcaacaccttcctgggcacccccgtgcagaagctggaccagcccggcaacctgcccggcagcaacagaagactgcagaccagaaaggagaaggcccaggccctggaggagctgaccggcttcagagagctgttccagaccccctgcaccgacaaccccaccaccgacgagaagaccaccaagaagatcctgtgcaagagcccccagagcgaccccgccgacacccccaccaacaccaagcagagacccaagagaagcctgaagaaggccgacgtggaggaggagttcctggccttcagaaagctgacccccagcgccggcaaggccatgcacacccccaaggccgccgtgggcgaggagaaggacatcaacaccttcgtgggcacccccgtggagaagctggacctgctgggcaacctgcccggcagcaagagaagaccccagacccccaaggagaaggccaaggccctggaggacctggccggcttcaaggagctgttccagacccccggccacaccgaggagagcatgaccgacgacaagatcaccgaggtgagctgcaagagcccccagcccgaccccgtgaagacccccaccagcagcaagcagagactgaagatcagcctgggcaaggtgggcgtgaaggaggaggtgctgcccgtgggcaagctgacccagaccagcggcaagaccacccagacccacagagagaccgccggcgacggcaagagcatcaaggccttcaaggagagcgccaagcagatgctggaccccgccaactacggcaccggcatggagagatggcccagaacccccaaggaggaggcccagagcctggaggacctggccggcttcaaggagctgttccagacccccgaccacaccgaggagagcaccaccgacgacaagaccaccaagatcgcctgcaagagccccccccccgagagcatggacacccccaccagcaccagaagaagacccaagacccccctgggcaagagagacatcgtggaggagctgagcgccctgaagcagctgacccagaccacccacaccgacaaggtgcccggcgacgaggacaagggcatcaacgtgttcagagagaccgccaagcagaagctggaccccgccgccagcgtgaccggcagcaagagacagcccagaacccccaagggcaaggcccagcccctggaggacctggccggcctgaaggagctgttccagacccccatctgcaccgacaagcccaccacccacgagaagaccaccaagatcgcctgcagaagcccccagcccgaccccgtgggcacccccaccatcttcaagccccagagcaagagaagcctgagaaaggccgacgtggaggaggagagcctggccctgagaaagagaacccccagcgtgggcaaggccatggacacccccaagcccgccggcggcgacgagaaggacatgaaggccttcatgggcacccccgtgcagaagctggacctgcccggcaacctgcccggcagcaagagatggccccagacccccaaggagaaggcccaggccctggaggacctggccggcttcaaggagctgttccagacccccggcaccgacaagcccaccaccgacgagaagaccaccaagatcgcctgcaagagcccccagcccgaccccgtggacacccccgccagcaccaagcagagacccaagagaaacctgagaaaggccgacgtggaggaggagttcctggccctgagaaagagaacccccagcgccggcaaggccatggacacccccaagcccgccgtgagcgacgagaagaacatcaacaccttcgtggagacccccgtgcagaagctggacctgctgggcaacctgcccggcagcaagagacagccccagacccccaaggagaaggccgaggccctggaggacctggtgggcttcaaggagctgttccagacccccggccacaccgaggagagcatgaccgacgacaagatcaccgaggtgagctgcaagagcccccagcccgagagcttcaagaccagcagaagcagcaagcagagactgaagatccccctggtgaaggtggacatgaaggaggagcccctggccgtgagcaagctgaccagaaccagcggcgagaccacccagacccacaccgagcccaccggcgacagcaagagcatcaaggccttcaaggagagccccaagcagatcctggaccccgccgccagcgtgaccggcagcagaagacagctgagaaccagaaaggagaaggccagagccctggaggacctggtggacttcaaggagctgttcagcgcccccggccacaccgaggagagcatgaccatcgacaagaacaccaagatcccctgcaagagccccccccccgagctgaccgacaccgccaccagcaccaagagatgccccaagaccagacccagaaaggaggtgaaggaggagctgagcgccgtggagagactgacccagaccagcggccagagcacccacacccacaaggagcccgccagcggcgacgagggcatcaaggtgctgaagcagagagccaagaagaagcccaaccccgtggaggaggagcccagcagaagaagacccagagcccccaaggagaaggcccagcccctggaggacctggccggcttcaccgagctgagcgagaccagcggccacacccaggagagcctgaccgccggcaaggccaccaagatcccctgcgagagcccccccctggaggtggtggacaccaccgccagcaccaagagacacctgagaaccagagtgcagaaggtgcaggtgaaggaggagcccagcgccgtgaagttcacccagaccagcggcgagaccaccgacgccgacaaggagcccgccggcgaggacaagggcatcaaggccctgaaggagagcgccaagcagacccccgcccccgccgccagcgtgaccggcagcagaagaagacccagagcccccagagagagcgcccaggccatcgaggacctggccggcttcaaggaccccgccgccggccacaccgaggagagcatgaccgacgacaagaccaccaagatcccctgcaagagcagccccgagctggaggacaccgccaccagcagcaagagaagacccagaaccagagcccagaaggtggaggtgaaggaggagctgctggccgtgggcaagctgacccagaccagcggcgagaccacccacaccgacaaggagcccgtgggcgagggcaagggcaccaaggccttcaagcagcccgccaagagaaagctggacgccgaggacgtgatcggcagcagaagacagcccagagcccccaaggagaaggcccagcccctggaggacctggccagcttccaggagctgagccagacccccggccacaccgaggagctggccaacggcgccgccgacagcttcaccagcgcccccaagcagacccccgacagcggcaagcccctgaagatcagcagaagagtgctgagagcccccaaggtggagcccgtgggcgacgtggtgagcaccagagaccccgtgaagagccagagcaagagcaacaccagcctgccccccctgcccttcaagagaggcggcggcaaggacggcagcgtgaccggcaccaagagactgagatgcatgcccgcccccgaggagatcgtggaggagctgcccgccagcaagaagcagagagtggcccccagagccagaggcaagagcagcgagcccgtggtgatcatgaagagaagcctgagaaccagcgccaagagaatcgagcccgccgaggagctgaacagcaacgacatgaagaccaacaaggaggagcacaagctgcaggacagcgtgcccgagaacaagggcatcagcctgagaagcagaagacagaacaagaccgaggccgagcagcagatcaccgaggtgttcgtgctggccgagagaatcgagatcaacagaaacgagaagaagcccatgaagaccagccccgagatggacatccagaaccccgacgacggcgccagaaagcccatccccagagacaaggtgaccgagaacaagagatgcctgagaagcgccagacagaacgagagcagccagcccaaggtggccgaggagagcggcggccagaagagcgccaaggtgctgatgcagaaccagaagggcaagggcgaggccggcaacagcgacagcatgtgcctgagaagcagaaagaccaagagccagcccgccgccagcaccctggagagcaagagcgtgcagagagtgaccagaagcgtgaagagatgcgccgagaaccccaagaaggccgaggacaacgtgtgcgtgaagaagatcagaaccagaagccacagagacagcgaggacatctag

SEQ ID NO: 9354 - DNA, 9768 bp, Artificial Sequence
  Description of Artificial Sequence: Synthetic coding sequence
atgtggcccaccagaagactggtgaccatcaagagaagcggcgtggacggcccccacttccccctgagcctgagcacctgcctgttcggcagaggcatcgagtgcgacatcagaatccagctgcccgtggtgagcaagcagcactgcaagatcgagatccacgagcaggaggccatcctgcacaacttcagcagcaccaaccccacccaggtgaacggcagcgtgatcgacgagcccgtgagactgaagcacggcgacgtgatcaccatcatcgacagaagcttcagatacgagaacgagagcctgcagaacggcagaaagagcaccgagttccccagaaagatcagagagcaggagcccgccagaagagtgagcagaagcagcttcagcagcgaccccgacgagaaggcccaggacagcaaggcctacagcaagatcaccgagggcaaggtgagcggcaacccccaggtgcacatcaagaacgtgaaggaggacagcaccgccgacgacagcaaggacagcgtggcccagggcaccaccaacgtgcacagcagcgagcacgccggcagaaacggcagaaacgccgccgaccccatcagcggcgacttcaaggagatcagcagcgtgaagctggtgagcagatacggcgagctgaagagcgtgcccaccacccagtgcctggacaacagcaagaagaacgagagccccttctggaagctgtacgagagcgtgaagaaggagctggacgtgaagagccagaaggagaacgtgctgcagtactgcagaaagagcggcctgcagaccgactacgccaccgagaaggagagcgccgacggcctgcagggcgagacccagctgctggtgagcagaaagagcagacccaagagcggcggcagcggccacgccgtggccgagcccgccagccccgagcaggagctggaccagaacaagggcaagggcagagacgtggagagcgtgcagacccccagcaaggccgtgggcgccagcttccccctgtacgagcccgccaagatgaagacccccgtgcagtacagccagcagcagaacagcccccagaagcacaagaacaaggacctgtacaccaccggcagaagagagagcgtgaacctgggcaagagcgagggcttcaaggccggcgacaagaccctgacccccagaaagctgagcaccagaaacagaacccccgccaaggtggaggacgccgccgacagcgccaccaagcccgagaacctgagcagcaagaccagaggcagcatccccaccgacgtggaggtgctgcccaccgagaccgagatccacaacgagcccttcctgaccctgtggctgacccaggtggagagaaagatccagaaggacagcctgagcaagcccgagaagctgggcaccaccgccggccagatgtgcagcggcctgcccggcctgagcagcgtggacatcaacaacttcggcgacagcatcaacgagagcgagggcatccccctgaagagaagaagagtgagcttcggcggccacctgagacccgagctgttcgacgagaacctgccccccaacacccccctgaagagaggcgaggcccccaccaagagaaagagcctggtgatgcacaccccccccgtgctgaagaagatcatcaaggagcagccccagcccagcggcaagcaggagagcggcagcgagatccacgtggaggtgaaggcccagagcctggtgatcagcccccccgcccccagccccagaaagacccccgtggccagcgaccagagaagaagaagctgcaagaccgcccccgccagcagcagcaagagccagaccgaggtgcccaagagaggcggcgagagagtggccacctgcctgcagagagtgagcatcagcagaagccagcacgacatcctgcagatgatctgcagcaagagaagaagcggcgccagcgaggccaacctgatcgtggccaagagctgggccgacgtggtgaagctgggcgccaagcagacccagaccaaggtgatcaagcacggcccccagagaagcatgaacaagagacagagaagacccgccacccccaagaagcccgtgggcgaggtgcacagccagttcagcaccggccacgccaacagcccctgcaccatcatcatcggcaaggcccacaccgagaaggtgcacgtgcccgccagaccctacagagtgctgaacaacttcatcagcaaccagaagatggacttcaaggaggacctgagcggcatcgccgagatgttcaagacccccgtgaaggagcagccccagctgaccagcacctgccacatcgccatcagcaacagcgagaacctgctgggcaagcagttccagggcaccgacagcggcgaggagcccctgctgcccaccagcgagagcttcggcggcaacgtgttcttcagcgcccagaacgccgccaagcagcccagcgacaagtgcagcgccagcccccccctgagaagacagtgcatcagagagaacggcaacgtggccaagacccccagaaacacctacaagatgaccagcctggagaccaagaccagcgacaccgagaccgagcccagcaagaccgtgagcaccgccaacagaagcggcagaagcaccgagttcagaaacatccagaagctgcccgtggagagcaagagcgaggagaccaacaccgagatcgtggagtgcatcctgaagagaggccagaaggccaccctgctgcagcagagaagagagggcgagatgaaggagatcgagagacccttcgagacctacaaggagaacatcgagctgaaggagaacgacgagaagatgaaggccatgaagagaagcagaacctggggccagaagtgcgcccccatgagcgacctgaccgacctgaagagcctgcccgacaccgagctgatgaaggacaccgccagaggccagaacctgctgcagacccaggaccacgccaaggcccccaagagcgagaagggcaagatcaccaagatgccctgccagagcctgcagcccgagcccatcaacacccccacccacaccaagcagcagctgaaggccagcctgggcaaggtgggcgtgaaggaggagctgctggccgtgggcaagttcaccagaaccagcggcgagaccacccacacccacagagagcccgccggcgacggcaagagcatcagaaccttcaaggagagccccaagcagatcctggaccccgccgccagagtgaccggcatgaagaagtggcccagaacccccaaggaggaggcccagagcctggaggacctggccggcttcaaggagctgttccagacccccggccccagcgaggagagcatgaccgacgagaagaccaccaagatcgcctgcaagagccccccccccgagagcgtggacacccccaccagcaccaagcagtggcccaagagaagcctgagaaaggccgacgtggaggaggagttcctggccctgagaaagctgacccccagcgccggcaaggccatgctgacccccaagcccgccggcggcgacgagaaggacatcaaggccttcatgggcacccccgtgcagaagctggacctggccggcaccctgcccggcagcaagagacagctgcagacccccaaggagaaggcccaggccctggaggacctggccggcttcaaggagctgttccagacccccggccacaccgaggagctggtggccgccggcaagaccaccaagatcccctgcgacagcccccagagcgaccccgtggacacccccaccagcaccaagcagagacccaagagaagcatcagaaaggccgacgtggagggcgagctgctggcctgcagaaacctgatgcccagcgccggcaaggccatgcacacccccaagcccagcgtgggcgaggagaaggacatcatcatcttcgtgggcacccccgtgcagaagctggacctgaccgagaacctgaccggcagcaagagaagaccccagacccccaaggaggaggcccaggccctggaggacctgaccggcttcaaggagctgttccagacccccggccacaccgaggaggccgtggccgccggcaagaccaccaagatgccctgcgagagcagcccccccgagagcgccgacacccccaccagcaccagaagacagcccaagacccccctggagaagagagacgtgcagaaggagctgagcgccctgaagaagctgacccagaccagcggcgagaccacccacaccgacaaggtgcccggcggcgaggacaagagcatcaacgccttcagagagaccgccaagcagaagctggaccccgccgccagcgtgaccggcagcaagagacaccccaagaccaaggagaaggcccagcccctggaggacctggccggcctgaaggagctgttccagacccccgtgtgcaccgacaagcccaccacccacgagaagaccaccaagatcgcctgcagaagccagcccgaccccgtggacacccccaccagcagcaagccccagagcaagagaagcctgagaaaggtggacgtggaggaggagttcttcgccctgagaaagagaacccccagcgccggcaaggccatgcacacccccaagcccgccgtgagcggcgagaagaacatctacgccttcatgggcacccccgtgcagaagctggacctgaccgagaacctgaccggcagcaagagaagactgcagacccccaaggagaaggcccaggccctggaggacctggccggcttcaaggagctgttccagaccagaggccacaccgaggagagcatgaccaacgacaagaccgccaaggtggcctgcaagagcagccagcccgaccccgacaagaaccccgccagcagcaagagaagactgaagaccagcctgggcaaggtgggcgtgaaggaggagctgctggccgtgggcaagctgacccagaccagcggcgagaccacccacacccacaccgagcccaccggcgacggcaagagcatgaaggccttcatggagagccccaagcagatcctggacagcgccgccagcctgaccggcagcaagagacagctgagaacccccaagggcaagagcgaggtgcccgaggacctggccggcttcatcgagctgttccagacccccagccacaccaaggagagcatgaccaacgagaagaccaccaaggtgagctacagagccagccagcccgacctggtggacacccccaccagcagcaagccccagcccaagagaagcctgagaaaggccgacaccgaggaggagttcctggccttcagaaagcagacccccagcgccggcaaggccatgcacacccccaagcccgccgtgggcgaggagaaggacatcaacaccttcctgggcacccccgtgcagaagctggaccagcccggcaacctgcccggcagcaacagaagactgcagaccagaaaggagaaggcccaggccctggaggagctgaccggcttcagagagctgttccagaccccctgcaccgacaaccccaccaccgacgagaagaccaccaagaagatcctgtgcaagagcccccagagcgaccccgccgacacccccaccaacaccaagcagagacccaagagaagcctgaagaaggccgacgtggaggaggagttcctggccttcagaaagctgacccccagcgccggcaaggccatgcacacccccaaggccgccgtgggcgaggagaaggacatcaacaccttcgtgggcacccccgtggagaagctggacctgctgggcaacctgcccggcagcaagagaagaccccagacccccaaggagaaggccaaggccctggaggacctggccggcttcaaggagctgttccagacccccggccacaccgaggagagcatgaccgacgacaagatcaccgaggtgagctgcaagagcccccagcccgaccccgtgaagacccccaccagcagcaagcagagactgaagatcagcctgggcaaggtgggcgtgaaggaggaggtgctgcccgtgggcaagctgacccagaccagcggcaagaccacccagacccacagagagaccgccggcgacggcaagagcatcaaggccttcaaggagagcgccaagcagatgctggaccccgccaactacggcaccggcatggagagatggcccagaacccccaaggaggaggcccagagcctggaggacctggccggcttcaaggagctgttccagacccccgaccacaccgaggagagcaccaccgacgacaagaccaccaagatcgcctgcaagagccccccccccgagagcatggacacccccaccagcaccagaagaagacccaagacccccctgggcaagagagacatcgtggaggagctgagcgccctgaagcagctgacccagaccacccacaccgacaaggtgcccggcgacgaggacaagggcatcaacgtgttcagagagaccgccaagcagaagctggaccccgccgccagcgtgaccggcagcaagagacagcccagaacccccaagggcaaggcccagcccctggaggacctggccggcctgaaggagctgttccagacccccatctgcaccgacaagcccaccacccacgagaagaccaccaagatcgcctgcagaagcccccagcccgaccccgtgggcacccccaccatcttcaagccccagagcaagagaagcctgagaaaggccgacgtggaggaggagagcctggccctgagaaagagaacccccagcgtgggcaaggccatggacacccccaagcccgccggcggcgacgagaaggacatgaaggccttcatgggcacccccgtgcagaagctggacctgcccggcaacctgcccggcagcaagagatggccccagacccccaaggagaaggcccaggccctggaggacctggccggcttcaaggagctgttccagacccccggcaccgacaagcccaccaccgacgagaagaccaccaagatcgcctgcaagagcccccagcccgaccccgtggacacccccgccagcaccaagcagagacccaagagaaacctgagaaaggccgacgtggaggaggagttcctggccctgagaaagagaacccccagcgccggcaaggccatggacacccccaagcccgccgtgagcgacgagaagaacatcaacaccttcgtggagacccccgtgcagaagctggacctgctgggcaacctgcccggcagcaagagacagccccagacccccaaggagaaggccgaggccctggaggacctggtgggcttcaaggagctgttccagacccccggccacaccgaggagagcatgaccgacgacaagatcaccgaggtgagctgcaagagcccccagcccgagagcttcaagaccagcagaagcagcaagcagagactgaagatccccctggtgaaggtggacatgaaggaggagcccctggccgtgagcaagctgaccagaaccagcggcgagaccacccagacccacaccgagcccaccggcgacagcaagagcatcaaggccttcaaggagagccccaagcagatcctggaccccgccgccagcgtgaccggcagcagaagacagctgagaaccagaaaggagaaggccagagccctggaggacctggtggacttcaaggagctgttcagcgcccccggccacaccgaggagagcatgaccatcgacaagaacaccaagatcccctgcaagagccccccccccgagctgaccgacaccgccaccagcaccaagagatgccccaagaccagacccagaaaggaggtgaaggaggagctgagcgccgtggagagactgacccagaccagcggccagagcacccacacccacaaggagcccgccagcggcgacgagggcatcaaggtgctgaagcagagagccaagaagaagcccaaccccgtggaggaggagcccagcagaagaagacccagagcccccaaggagaaggcccagcccctggaggacctggccggcttcaccgagctgagcgagaccagcggccacacccaggagagcctgaccgccggcaaggccaccaagatcccctgcgagagcccccccctggaggtggtggacaccaccgccagcaccaagagacacctgagaaccagagtgcagaaggtgcaggtgaaggaggagcccagcgccgtgaagttcacccagaccagcggcgagaccaccgacgccgacaaggagcccgccggcgaggacaagggcatcaaggccctgaaggagagcgccaagcagacccccgcccccgccgccagcgtgaccggcagcagaagaagacccagagcccccagagagagcgcccaggccatcgaggacctggccggcttcaaggaccccgccgccggccacaccgaggagagcatgaccgacgacaagaccaccaagatcccctgcaagagcagccccgagctggaggacaccgccaccagcagcaagagaagacccagaaccagagcccagaaggtggaggtgaaggaggagctgctggccgtgggcaagctgacccagaccagcggcgagaccacccacaccgacaaggagcccgtgggcgagggcaagggcaccaaggccttcaagcagcccgccaagagaaagctggacgccgaggacgtgatcggcagcagaagacagcccagagcccccaaggagaaggcccagcccctggaggacctggccagcttccaggagctgagccagacccccggccacaccgaggagctggccaacggcgccgccgacagcttcaccagcgcccccaagcagacccccgacagcggcaagcccctgaagatcagcagaagagtgctgagagcccccaaggtggagcccgtgggcgacgtggtgagcaccagagaccccgtgaagagccagagcaagagcaacaccagcctgccccccctgcccttcaagagaggcggcggcaaggacggcagcgtgaccggcaccaagagactgagatgcatgcccgcccccgaggagatcgtggaggagctgcccgccagcaagaagcagagagtggcccccagagccagaggcaagagcagcgagcccgtggtgatcatgaagagaagcctgagaaccagcgccaagagaatcgagcccgccgaggagctgaacagcaacgacatgaagaccaacaaggaggagcacaagctgcaggacagcgtgcccgagaacaagggcatcagcctgagaagcagaagacagaacaagaccgaggccgagcagcagatcaccgaggtgttcgtgctggccgagagaatcgagatcaacagaaacgagaagaagcccatgaagaccagccccgagatggacatccagaaccccgacgacggcgccagaaagcccatccccagagacaaggtgaccgagaacaagagatgcctgagaagcgccagacagaacgagagcagccagcccaaggtggccgaggagagcggcggccagaagagcgccaaggtgctgatgcagaaccagaagggcaagggcgaggccggcaacagcgacagcatgtgcctgagaagcagaaagaccaagagccagcccgccgccagcaccctggagagcaagagcgtgcagagagtgaccagaagcgtgaagagatgcgccgagaaccccaagaaggccgaggacaacgtgtgcgtgaagaagatcagaaccagaagccacagagacagcgaggacatctag

SEQ ID NO: 9355 - DNA, 141 bp, Artificial Sequence
  Description of Artificial Sequence: Synthetic coding sequence
atgtggcccaccagaagactggtgaccatcaagagaagcggcgtggacggcccccacttccccctgagcctgagcacctgcctgttcggcagaagaaagtgcgtgctgcagtgcaccgagtgcagcaagaccgccatctag

SEQ ID NO: 9356 - DNA, 1557 bp, Artificial Sequence
  Description of Artificial Sequence: Synthetic coding sequence
atgctgagagtggtgagctggaacatcaacggcatcagaagacccctgcagggcgtggccaaccaggagcccagcaactgcgccgccgtggccgtgggcagaatcctggacgagctggacgccgacatcgtgtgcctgcaggagaccaaggtgaccagagacgccctgaccgagcccctggccatcgtggagggctacaacagctacttcagcttcagcagaaacagaagcggctacagcggcgtggccaccttctgcaaggacaacgccacccccgtggccgccgaggagggcctgagcggcctgttcgccacccagaacggcgacgtgggctgctacggcaacatggacgagttcacccaggaggagctgagagccctggacagcgagggcagagccctgctgacccagcacaagatcagaacctgggagggcaaggagaagaccctgaccctgatcaacgtgtactgcccccacgccgaccccggcagacccgagagactggtgttcaagatgagattctacagactgctgcagatcagagccgaggccctgctggccgccggcagccacgtgatcatcctgggcgacctgaacaccgcccacagacccatcgaccactgggacgccgtgaacctggagtgcttcgaggaggaccccggcagaaagtggatggacagcctgctgagcaacctgggctgccagagcgccagccacgtgggccccttcatcgacagctacagatgcttccagcccaagcaggagggcgccttcacctgctggagcgccgtgaccggcgccagacacctgaactacggcagcagactggactacgtgctgggcgacagaaccctggtgatcgacaccttccaggccagcttcctgctgcccgaggtgatgggcagcgaccactgccccgtgggcgccgtgctgagcgtgagcagcgtgcccgccaagcagtgcccccccctgtgcaccagattcctgcccgagttcgccggcacccagctgaagatcctgagattcctggtgcccctggagcagagccccgtgctggagcagagcaccctgcagcacaacaaccagaccagagtgcagacctgccagaacaaggcccaggtgagaagcaccagaccccagcccagccaggtgggcagcagcagaggccagaagaacctgaagagctacttccagcccagccccagctgcccccaggccagccccgacatcgagctgcccagcctgcccctgatgagcgccctgatgacccccaagacccccgaggagaaggccgtggccaaggtggtgaagggccaggccaagaccagcgaggccaaggacgagaaggagctgagaaccagcttctggaagagcgtgctggccggccccctgagaacccccctgtgcggcggccacagagagccctgcgtgatgagaaccgtgaagaagcccggccccaacctgggcagaagattctacatgtgcgccagacccagaggcccccccaccgaccccagcagcagatgcaacttcttcctgtggagcagacccagctag

SEQ ID NO: 9357 - DNA, 1191 bp, Artificial Sequence
  Description of Artificial Sequence: Synthetic coding sequence
atgcccagagtgaaggccgcccaggccggcagacagagcagcgccaagagacacctggccgagcagttcgccgtgggcgagatcatcaccgacatggccaagaaggagtggaaggtgggcctgcccatcggccagggcggcttcggctgcatctacctggccgacatgaacagcagcgagagcgtgggcagcgacgccccctgcgtggtgaaggtggagcccagcgacaacggccccctgttcaccgagctgaagttctaccagagagccgccaagcccgagcagatccagaagtggatcagaaccagaaagctgaagtacctgggcgtgcccaagtactggggcagcggcctgcacgacaagaacggcaagagctacagattcatgatcatggacagattcggcagcgacctgcagaagatctacgaggccaacgccaagagattcagcagaaagaccgtgctgcagctgagcctgagaatcctggacatcctggagtacatccacgagcacgagtacgtgcacggcgacatcaaggccagcaacctgctgctgaactacaagaaccccgaccaggtgtacctggtggactacggcctggcctacagatactgccccgagggcgtgcacaaggagtacaaggaggaccccaagagatgccacgacggcaccatcgagttcaccagcatcgacgcccacaacggcgtggcccccagcagaagaggcgacctggagatcctgggctactgcatgatccagtggctgaccggccacctgccctgggaggacaacctgaaggaccccaagtacgtgagagacagcaagatcagatacagagagaacatcgccagcctgatggacaagtgcttccccgagaagaacaagcccggcgagatcgccaagtacatggagaccgtgaagctgctggactacaccgagaagcccctgtacgagaacctgagagacatcctgctgcagggcctgaaggccatcggcagcaaggacgacggcaagctggacctgagcgtggtggagaacggcggcctgaaggccaagaccatcaccaagaagagaaagaaggagatcgaggagagcaaggagcccggcgtggaggacaccgagtggagcaacacccagaccgaggaggccatccagaccagaagcagaaccagaaagagagtgcagaagtag

SEQ ID NO: 9358 - DNA, 957 bp, Artificial Sequence
  Description of Artificial Sequence: Synthetic coding sequence
atgcccaagagaggcaagaagggcgccgtggccgaggacggcgacgagctgagaaccgagcccgaggccaagaagagcaagaccgccgccaagaagaacgacaaggaggccgccggcgagggccccgccctgtacgaggacccccccgaccagaagaccagccccagcggcaagcccgccaccctgaagatctgcagctggaacgtggacggcctgagagcctggatcaagaagaagggcctggactgggtgaaggaggaggcccccgacatcctgtgcctgcaggagaccaagtgcagcgagaacaagctgcccgccgagctgcaggagctgcccggcctgagccaccagtactggagcgcccccagcgacaaggagggctacagcggcgtgggcctgctgagcagacagtgccccctgaaggtgagctacggcatcggcgacgaggagcacgaccaggagggcagagtgatcgtggccgagttcgacagcttcgtgctggtgaccgcctacgtgcccaacgccggcagaggcctggtgagactggagtacagacagagatgggacgaggccttcagaaagttcctgaagggcctggccagcagaaagcccctggtgctgtgcggcgacctgaacgtggcccacgaggagatcgacctgagaaaccccaagggcaacaagaagaacgccggcttcaccccccaggagagacagggcttcggcgagctgctgcaggccgtgcccctggccgacagcttcagacacctgtaccccaacaccccctacgcctacaccttctggacctacatgatgaacgccagaagcaagaacgtgggctggagactggactacttcctgctgagccacagcctgctgcccgccctgtgcgacagcaagatcagaagcaaggccctgggcagcgaccactgccccatcaccctgtacctggccctgtag

SEQ ID NO: 9359 - DNA, 792 bp, Artificial Sequence
  Description of Artificial Sequence: Synthetic coding sequence
atgcccaagagaggcaagaagggcgccgtggccgaggacggcgacgagctgagaaccgagcccgaggccaagaagagcaagaccgccgccaagaagaacgacaaggaggccgccggcgagggccccgccctgtacgaggacccccccgaccagaagaccagccccagcggcaagcccgccaccctgaagatctgcagctggaacgtggacggcctgagagcctggatcaagaagaagggcctggactgggtgaaggaggaggcccccgacatcctgtgcctgcaggagaccaagtgcagcgagaacaagctgcccgccgagctgcaggagctgcccggcctgagccaccagtactggagcgcccccagcgacaaggagggctacagcggcgtgggcctgctgagcagacagtgccccctgaaggtgagctacggcatcggcgacgaggagcacgaccaggagggcagagtgatcgtggccgagttcgacagcttcgtgctggtgaccgcctacgtgcccaacgccggcagaggcctggtgagactggagtacagacagagatgggacgaggccttcagaaagttcctgaagggcctggccagcagaaagcccctggtgctgtgcggcgacctgaacgtggcccacgaggagatcgacctgagaaaccccaagggcaacaagaagaacgccggcttcaccccccaggagagacagggcttcggcgagctgctgcaggccgtgcccctggccgacagcttcagacacctgtaccccaacaccccctacgcctag

SEQ ID NO: 9360 - DNA, 957 bp, Artificial Sequence; identical to SEQ ID NO: 9358
  Description of Artificial Sequence: Synthetic coding sequence

SEQ ID NO: 9361 - DNA, 525 bp, Artificial Sequence
  Description of Artificial Sequence: Synthetic coding sequence
atgcccaagagaggcaagaagggcgccgtggccgaggacggcgacgagctgagaaccgagcccgaggccaagaagagcaagaccgccgccaagaagaacgacaaggaggccgccggcgagggccccgccctgtacgaggacccccccgaccagaagaccagccccagcggcaagcccgccaccctgaagatctgcagctggaacgtggacggcctgagagcctggatcaagaagaagggcctggactgggtgaaggaggaggcccccgacatcctgtgcctgcaggagaccaagtgcagcgagaacaagctgcccgccgagctgcaggagctgcccggcctgagccaccagtactggagcgcccccagcgacaaggagggctacagcggcgtgggcctgctgagcagacagtgccccctgaaggtgagctacggcatcggcgacgaggagcacgaccaggagggcagagtgatcgtggccgagttcgacagcttcgtgctggtgaccgcctacgtgcccaactag

SEQ ID NO: 9362 - DNA, 327 bp, Artificial Sequence
  Description of Artificial Sequence: Synthetic coding sequence
atgcccaagagaggcaagaagggcgccgtggccgaggacggcgacgagctgagaaccgagcccgaggccaagaagagcaagaccgccgccaagaagaacgacaaggaggccgccggcgagggccccgccctgtacgaggacccccccgaccagaagaccagccccagcggcaagcccgccaccctgaagatctgcagctggaacgtggacggcctgagagcctggatcaagaagaagggcctggactgggtgaaggaggaggcccccgacatcctgtgcctgcaggagaccaagtgcagcgagaacaagctgcccgccgagctgtag

SEQ ID NO: 9363 - DNA, 441 bp, Artificial Sequence
  Description of Artificial Sequence: Synthetic coding sequence
atgcccaagagaggcaagaagggcgccgtggccgaggacggcgacgagctgagaaccgagcccgaggccaagaagagcaagaccgccgccaagaagaacgacaaggaggccgccggcgagggccccgccctgtacgaggacccccccgaccagaagaccagccccagcggcaagcccgccaccctgaagatctgcagctggaacgtggacggcctgagagcctggatcaagaagaagggcctggactgggtgaaggaggaggcccccgacatcctgtgcctgcaggagaccaagtgcagcgagaacaagctgcccgccgagctgcaggagctgcccggcctgagccaccagtactggagcgcccccagcgacaaggagggctacagcggcgtgggcctgctgagcagacagtgccccctgaaggtgagctacggcatctag

SEQ ID NO: 9364 - DNA, 975 bp, Artificial Sequence
  Description of Artificial Sequence: Synthetic coding sequence
atgttcagatgcggcggcctggccgccggcgccctgaagcagaagctggtgcccctggtgagaaccgtgtgcgtgagaagccccagacagagaaacagactgcccggcaacctgttccagagatggcacgtgcccctggagctgcagatgaccagacagatggccagcagcggcgccagcggcggcaagatcgacaacagcgtgctggtgctgatcgtgggcctgagcaccgtgggcgccggcgcctacgcctacaagaccatgaaggaggacgagaagagatacaacgagagaatcagcggcctgggcctgacccccgagcagaagcagaagaaggccgccctgagcgccagcgagggcgaggaggtgccccaggacaaggcccccagccacgtgcccttcctgctgatcggcggcggcaccgccgccttcgccgccgccagaagcatcagagccagagaccccggcgccagagtgctgatcgtgagcgaggaccccgagctgccctacatgagaccccccctgagcaaggagctgtggttcagcgacgaccccaacgtgaccaagaccctgagattcaagcagtggaacggcaaggagagaagcatctacttccagccccccagcttctacgtgagcgcccaggacctgccccacatcgagaacggcggcgtggccgtgctgaccggcaagaaggtggtgcagctggacgtgagagacaacatggtgaagctgaacgacggcagccagatcacctacgagaagtgcctgatcgccaccggcggcacccccagaagcctgagcgccatcgacagagccggcgccgaggtgaagagcagaaccaccctgttcagaaagatcggcgacttcagaagcctggagaagatcagcagagaggtgaagagcatcaccatcatcggcggcggcttcctgggcagcgagctggcctgcgccctgggcagaaaggacatctag

SEQ ID NO: 9365 - DNA, 1842 bp, Artificial Sequence
  Description of Artificial Sequence: Synthetic coding sequence
atgttcagatgcggcggcctggccgccggcgccctgaagcagaagctggtgcccctggtgagaaccgtgtgcgtgagaagccccagacagagaaacagactgcccggcaacctgttccagagatggcacgtgcccctggagctgcagatgaccagacagatggccagcagcggcgccagcggcggcaagatcgacaacagcgtgctggtgctgatcgtgggcctgagcaccgtgggcgccggcgcctacgcctacaagaccatgaaggaggacgagaagagatacaacgagagaatcagcggcctgggcctgacccccgagcagaagcagaagaaggccgccctgagcgccagcgagggcgaggaggtgccccaggacaaggcccccagccacgtgcccttcctgctgatcggcggcggcaccgccgccttcgccgccgccagaagcatcagagccagagaccccggcgccagagtgctgatcgtgagcgaggaccccgagctgccctacatgagaccccccctgagcaaggagctgtggttcagcgacgaccccaacgtgaccaagaccctgagattcaagcagtggaacggcaaggagagaagcatctacttccagccccccagcttctacgtgagcgcccaggacctgccccacatcgagaacggcggcgtggccgtgctgaccggcaagaaggtggtgcagctggacgtgagagacaacatggtgaagctgaacgacggcagccagatcacctacgagaagtgcctgatcgccaccggcggcacccccagaagcctgagcgccatcgacagagccggcgccgaggtgaagagcagaaccaccctgttcagaaagatcggcgacttcagaagcctggagaagatcagcagagaggtgaagagcatcaccatcatcggcggcggcttcctgggcagcgagctggcctgcgccctgggcagaaaggccagagccctgggcaccgaggtgatccagctgttccccgagaagggcaacatgggcaagatcctgcccgagtacctgagcaactggaccatggagaaggtgagaagagagggcgtgaaggtgatgcccaacgccatcgtgcagagcgtgggcgtgagcagcggcaagctgctgatcaagctgaaggacggcagaaaggtggagaccgaccacatcgtggccgccgtgggcctggagcccaacgtggagctggccaagaccggcggcctggagatcgacagcgacttcggcggcttcagagtgaacgccgagctgcaggccagaagcaacatctgggtggccggcgacgccgcctgcttctacgacatcaagctgggcagaagaagagtggagcaccacgaccacgccgtggtgagcggcagactggccggcgagaacatgaccggcgccgccaagccctactggcaccagagcatgttctggagcgacctgggccccgacgtgggctacgaggccatcggcctggtggacagcagcctgcccaccgtgggcgtgttcgccaaggccaccgcccaggacaaccccaagagcgccaccgagcagagcggcaccggcatcagaagcgagagcgagaccgagagcgaggccagcgagatcaccatcccccccagcacccccgccgtgccccaggcccccgtgcagggcgaggactacggcaagggcgtgatcttctacctgagagacaaggtggtggtgggcatcgtgctgtggaacatcttcaacagaatgcccatcgccagaaagatcatcaaggacggcgagcagcacgaggacctgaacgaggtggccaagctgttcaacatccacgaggactag

SEQ ID NO: 9366 - DNA, 1830 bp, Artificial Sequence
  Description of Artificial Sequence: Synthetic coding sequence
atgttcagatgcggcggcctggccgccggcgccctgaagcagaagctggtgcccctggtgagaaccgtgtgcgtgagaagccccagacagagaaacagactgcccgtggtgcagagccaccacctgggcagccccagcagaagcctggccagcaccggcgccagcggcaaggacggcagcaacctggtgtacttcctgatcgtgggcgccaccgtgaccggcgccggcgtgtactacgcctacaagaccatgaaggaggacgagaagagatacaacgagagaatcagcggcctgggcctgacccccgagcagaagcagaagaaggccgccctgagcgccagcgagggcgaggaggtgccccaggacaaggcccccagccacgtgcccttcctgctgatcggcggcggcaccgccgccttcgccgccgccagaagcatcagagccagagaccccggcgccagagtgctgatcgtgagcgaggaccccgagctgccctacatgagaccccccctgagcaaggagctgtggttcagcgacgaccccaacgtgaccaagaccctgagattcaagcagtggaacggcaaggagagaagcatctacttccagccccccagcttctacgtgagcgcccaggacctgccccacatcgagaacggcggcgtggccgtgctgaccggcaagaaggtggtgcagctggacgtgagagacaacatggtgaagctgaacgacggcagccagatcacctacgagaagtgcctgatcgccaccggcggcacccccagaagcctgagcgccatcgacagagccggcgccgaggtgaagagcagaaccaccctgttcagaaagatcggcgacttcagaagcctggagaagatcagcagagaggtgaagagcatcaccatcatcggcggcggcttcctgggcagcgagctggcctgcgccctgggcagaaaggccagagccctgggcaccgaggtgatccagctgttccccgagaagggcaacatgggcaagatcctgcccgagtacctgagcaactggaccatggagaaggtgagaagagagggcgtgaaggtgatgcccaacgccatcgtgcagagcgtgggcgtgagcagcggcaagctgctgatcaagctgaaggacggcagaaaggtggagaccgaccacatcgtggccgccgtgggcctggagcccaacgtggagctggccaagaccggcggcctggagatcgacagcgacttcggcggcttcagagtgaacgccgagctgcaggccagaagcaacatctgggtggccggcgacgccgcctgcttctacgacatcaagctgggcagaagaagagtggagcaccacgaccacgccgtggtgagcggcagactggccggcgagaacatgaccggcgccgccaagccctactggcaccagagcatgttctggagcgacctgggccccgacgtgggctacgaggccatcggcctggtggacagcagcctgcccaccgtgggcgtgttcgccaaggccaccgcccaggacaaccccaagagcgccaccgagcagagcggcaccggcatcagaagcgagagcgagaccgagagcgaggccagcgagatcaccatcccccccagcacccccgccgtgccccaggcccccgtgcagggcgaggactacggcaagggcgtgatcttctacctgagagacaaggtggtggtgggcatcgtgctgtggaacatcttcaacagaatgcccatcgccagaaagatcatcaaggacggcgagcagcacgaggacctgaacgaggtggccaagctgttcaacatccacgaggactag

SEQ ID NO: 9367 - DNA, 981 bp, Artificial Sequence
  Description of Artificial Sequence: Synthetic coding sequence
atgttcagatgcggcggcctggccgccggcgccctgaagcagaagctggtgcccctggtgagaaccgtgtgcgtgagaagccccagacagagaaacagactgcccgccagagccctgggcaccgaggtgatccagctgttccccgagaagggcaacatgggcaagatcctgcccgagtacctgagcaactggaccatggagaaggtgagaagagagggcgtgaaggtgatgcccaacgccatcgtgcagagcgtgggcgtgagcagcggcaagctgctgatcaagctgaaggacggcagaaaggtggagaccgaccacatcgtggccgccgtgggcctggagcccaacgtggagctggccaagaccggcggcctggagatcgacagcgacttcggcggcttcagagtgaacgccgagctgcaggccagaagcaacatctgggtggccggcgacgccgcctgcttctacgacatcaagctgggcagaagaagagtggagcaccacgaccacgccgtggtgagcggcagactggccggcgagaacatgaccggcgccgccaagccctactggcaccagagcatgttctggagcgacctgggccccgacgtgggctacgaggccatcggcctggtggacagcagcctgcccaccgtgggcgtgttcgccaaggccaccgcccaggacaaccccaagagcgccaccgagcagagcggcaccggcatcagaagcgagagcgagaccgagagcgaggccagcgagatcaccatcccccccagcacccccgccgtgccccaggcccccgtgcagggcgaggactacggcaagggcgtgatcttctacctgagagacaaggtggtggtgggcatcgtgctgtggaacatcttcaacagaatgcccatcgccagaaagatcatcaaggacggcgagcagcacgaggacctgaacgaggtggccaagctgttcaacatccacgaggactag

SEQ ID NO: 9368 - DNA, 786 bp, Artificial Sequence
  Description of Artificial Sequence: Synthetic coding sequence
atggagaaggtgagaagagagggcgtgaaggtgatgcccaacgccatcgtgcagagcgtgggcgtgagcagcggcaagctgctgatcaagctgaaggacggcagaaaggtggagaccgaccacatcgtggccgccgtgggcctggagcccaacgtggagctggccaagaccggcggcctggagatcgacagcgacttcggcggcttcagagtgaacgccgagctgcaggccagaagcaacatctgggtggccggcgacgccgcctgcttctacgacatcaagctgggcagaagaagagtggagcaccacgaccacgccgtggtgagcggcagactggccggcgagaacatgaccggcgccgccaagccctactggcaccagagcatgttctggagcgacctgggccccgacgtgggctacgaggccatcggcctggtggacagcagcctgcccaccgtgggcgtgttcgccaaggccaccgcccaggacaaccccaagagcgccaccgagcagagcggcaccggcatcagaagcgagagcgagaccgagagcgaggccagcgagatcaccatcccccccagcacccccgccgtgccccaggcccccgtgcagggcgaggactacggcaagggcgtgatcttctacctgagagacaaggtggtggtgggcatcgtgctgtggaacatcttcaacagaatgcccatcgccagaaagatcatcaaggacggcgagcagcacgaggacctgaacgaggtggccaagctgttcaacatccacgaggactag

SEQ ID NO: 9369 - DNA, 825 bp, Artificial Sequence
  Description of Artificial Sequence: Synthetic coding sequence
atgggcaagatcctgcccgagtacctgagcaactggaccatggagaaggtgagaagagagggcgtgaaggtgatgcccaacgccatcgtgcagagcgtgggcgtgagcagcggcaagctgctgatcaagctgaaggacggcagaaaggtggagaccgaccacatcgtggccgccgtgggcctggagcccaacgtggagctggccaagaccggcggcctggagatcgacagcgacttcggcggcttcagagtgaacgccgagctgcaggccagaagcaacatctgggtggccggcgacgccgcctgcttctacgacatcaagctgggcagaagaagagtggagcaccacgaccacgccgtggtgagcggcagactggccggcgagaacatgaccggcgccgccaagccctactggcaccagagcatgttctggagcgacctgggccccgacgtgggctacgaggccatcggcctggtggacagcagcctgcccaccgtgggcgtgttcgccaaggccaccgcccaggacaaccccaagagcgccaccgagcagagcggcaccggcatcagaagcgagagcgagaccgagagcgaggccagcgagatcaccatcccccccagcacccccgccgtgccccaggcccccgtgcagggcgaggactacggcaagggcgtgatcttctacctgagagacaaggtggtggtgggcatcgtgctgtggaacatcttcaacagaatgcccatcgccagaaagatcatcaaggacggcgagcagcacgaggacctgaacgaggtggccaagctgttcaacatccacgaggactag

SEQ ID NO: 9370 - DNA, 714 bp, Artificial Sequence
  Description of Artificial Sequence: Synthetic coding sequence
atgaaggaggacgagaagagatacaacgagagaatcagcggcctgggcctgacccccgagcagaagcagaagaaggccgccctgagcgccagcgagggcgaggaggtgccccaggacaaggcccccagccacgtgcccttcctgctgatcggcggcggcaccgccgccttcgccgccgccagaagcatcagagccagagaccccggcgccagagtgctgatcgtgagcgaggaccccgagctgccctacatgagaccccccctgagcaaggagctgtggttcagcgacgaccccaacgtgaccaagaccctgagattcaagcagtggaacggcaaggagagaagcatctacttccagccccccagcttctacgtgagcgcccaggacctgccccacatcgagaacggcggcgtggccgtgctgaccggcaagaaggtggtgcagctggacgtgagagacaacatggtgaagctgaacgacggcagccagatcacctacgagaagtgcctgatcgccaccggcggcacccccagaagcctgagcgccatcgacagagccggcgccgaggtgaagagcagaaccaccctgttcagaaagatcggcgacttcagaagcctggagaagatcagcagagaggtgaagagcatcaccatcatcggcggcggcttcctgggcagcgagctggcctgcgccctgggcagaaaggacatctag

SEQ ID NO: 9371 - DNA, 1017 bp, Artificial Sequence
  Description of Artificial Sequence: Synthetic coding sequence
atggacgccaaggccagaaactgcctgctgcagcacagagaggccctggagaaggacatcaagaccagctacatcatggaccacatgatcagcgacggcttcctgaccatcagcgaggaggagaaggtgagaaacgagcccacccagcagcagagagccgccatgctgatcaagatgatcctgaagaaggacaacgacagctacgtgagcttctacaacgccctgctgcacgagggctacaaggacctggccgccctgctgcacgacggcatccccgtggtgagcagcagcagcggcaaggacagcgtgagcggcatcaccagctacgtgagaaccgtgctgtgcgagggcggcgtgccccagagacccgtggtgttcgtgaccagaaagaagctggtgaacgccatccagcagaagctgagcaagctgaagggcgagcccggctgggtgaccatccacggcatggccggctgcggcaagagcgtgctggccgccgaggccgtgagagaccacagcctgctggagggctgcttccccggcggcgtgcactgggtgagcgtgggcaagcaggacaagagcggcctgctgatgaagctgcagaacctgtgcaccagactggaccaggacgagagcttcagccagagactgcccctgaacatcgaggaggccaaggacagactgagaatcctgatgctgagaaagcaccccagaagcctgctgatcctggacgacgtgtgggacagctgggtgctgaaggccttcgacagccagtgccagatcctgctgaccaccagagacaagagcgtgaccgacagcgtgatgggccccaagtacgtggtgcccgtggagagcagcctgggcaaggagaagggcctggagatcctgagcctgttcgtgaacatgaagaaggccgacctgcccgagcaggcccacagcatcatcaaggagtgcaaggtggtggagagatgccactggggcatcctgaccgacctgctgcacaagtggaaccagagctag

SEQ ID NO: 9372 - DNA, 3492 bp, Artificial Sequence
  Description of Artificial Sequence: Synthetic coding sequence
atggacgccaaggccagaaactgcctgctgcagcacagagaggccctggagaaggacatcaagaccagctacatcatggaccacatgatcagcgacggcttcctgaccatcagcgaggaggagaaggtgagaaacgagcccacccagcagcagagagccgccatgctgatcaagatgatcctgaagaaggacaacgacagctacgtgagcttctacaacgccctgctgcacgagggctacaaggacctggccgccctgctgcacgacggcatccccgtggtgagcagcagcagcggcaaggacagcgtgagcggcatcaccagctacgtgagaaccgtgctgtgcgagggcggcgtgccccagagacccgtggtgttcgtgaccagaaagaagctggtgaacgccatccagcagaagctgagcaagctgaagggcgagcccggctgggtgaccatccacggcatggccggctgcggcaagagcgtgctggccgccgaggccgtgagagaccacagcctgctggagggctgcttccccggcggcgtgcactgggtgagcgtgggcaagcaggacaagagcggcctgctgatgaagctgcagaacctgtgcaccagactggaccaggacgagagcttcagccagagactgcccctgaacatcgaggaggccaaggacagactgagaatcctgatgctgagaaagcaccccagaagcctgctgatcctggacgacgtgtgggacagctgggtgctgaaggccttcgacagccagtgccagatcctgctgaccaccagagacaagagcgtgaccgacagcgtgatgggccccaagtacgtggtgcccgtggagagcagcctgggcaaggagaagggcctggagatcctgagcctgttcgtgaacatgaagaaggccgacctgcccgagcaggcccacagcatcatcaaggagtgcaagggcagccccctggtggtgagcctgatcggcgccctgctgagagacttccccaacagatgggagtactacctgaagcagctgcagaacaagcagttcaagagaatcagaaagagcagcagctacgactacgaggccctggacgaggccatgagcatcagcgtggagatgctgagagaggacatcaaggactactacaccgacctgagcatcctgcagaaggacgtgaaggtgcccaccaaggtgctgtgcatcctgtgggacatggagaccgaggaggtggaggacatcctgcaggagttcgtgaacaagagcctgctgttctgcgacagaaacggcaagagcttcagatactacctgcacgacctgcaggtggacttcctgaccgagaagaactgcagccagctgcaggacctgcacaagaagatcatcacccagttccagagataccaccagccccacaccctgagccccgaccaggaggactgcatgtactggtacaacttcctggcctaccacatggccagcgccaagatgcacaaggagctgtgcgccctgatgttcagcctggactggatcaaggccaagaccgagctggtgggccccgcccacctgatccacgagttcgtggagtacagacacatcctggacgagaaggactgcgccgtgagcgagaacttccaggagttcctgagcctgaacggccacctgctgggcagacagcccttccccaacatcgtgcagctgggcctgtgcgagcccgagaccagcgaggtgtaccagcaggccaagctgcaggccaagcaggaggtggacaacggcatgctgtacctggagtggatcaacaagaagaacatcaccaacctgagcagactggtggtgagaccccacaccgacgccgtgtaccacgcctgcttcagcgaggacggccagagaatcgccagctgcggcgccgacaagaccctgcaggtgttcaaggccgagaccggcgagaagctgctggagatcaaggcccacgaggacgaggtgctgtgctgcgccttcagcaccgacgacagattcatcgccacctgcagcgtggacaagaaggtgaagatctggaacagcatgaccggcgagctggtgcacacctacgacgagcacagcgagcaggtgaactgctgccacttcaccaacagcagccaccacctgctgctggccaccggcagcagcgactgcttcctgaagctgtgggacctgaaccagaaggagtgcagaaacaccatgttcggccacaccaacagcgtgaaccactgcagattcagccccgacgacaagctgctggccagctgcagcgccgacggcaccctgaagctgtgggacgccaccagcgccaacgagagaaagagcatcaacgtgaagcagttcttcctgaacctggaggacccccaggaggacatggaggtgatcgtgaagtgctgcagctggagcgccgacggcgccagaatcatggtggccgccaagaacaagatcttcctgtggaacaccgacagcagaagcaaggtggccgactgcagaggccacctgagctgggtgcacggcgtgatgttcagccccgacggcagcagcttcctgaccagcagcgacgaccagaccatcagactgtgggagaccaagaaggtgtgcaagaacagcgccgtgatgctgaagcaggaggtggacgtggtgttccaggagaacgaggtgatggtgctggccgtggaccacatcagaagactgcagctgatcaacggcagaaccggccagatcgactacctgaccgaggcccaggtgagctgctgctgcctgagcccccacctgcagtacatcgccttcggcgacgagaacggcgccatcgagatcctggagctggtgaacaacagaatcttccagagcagattccagcacaagaagaccgtgtggcacatccagttcaccgccgacgagaagaccctgatcagcagcagcgacgacgccgagatccaggtgtggaactggcagctggacaagtgcatcttcctgagaggccaccaggagaccgtgaaggacttcagactgctgaagaacagcagactgctgagctggagcttcgacggcaccgtgaaggtgtggaacatcatcaccggcaacaaggagaaggacttcgtgtgccaccagggcaccgtgctgagctgcgacatcagccacgacgccaccaagttcagcagcaccagcgccgacaagaccgccaagatctggaacgtgagcaacggcgagctgctgcacctgtgcgcccccctgagcgaggagggcgccgccacccacggcggctgggtgaccgacctgtgcttcagccccgacggcaagatgctgatcagcgccggcggctacatcaagtggtggaacgtggtgaccggcgagagcagccagaccttctacaccaacggcaccaacctgaagaagatccacgtgagccccgacttcaagacctacgtgaccgtggacaacctgggcatcctgtacatcctgcagaccctggagtag

SEQ ID NO: 9373 - DNA, 3618 bp, Artificial Sequence
  Description of Artificial Sequence: Synthetic coding sequence
atggacgccaaggccagaaactgcctgctgcagcacagagaggccctggagaaggacatcaagaccagctacatcatggaccacatgatcagcgacggcttcctgaccatcagcgaggaggagaaggtgagaaacgagcccacccagcagcagagagccgccatgctgatcaagatgatcctgaagaaggacaacgacagctacgtgagcttctacaacgccctgctgcacgagggctacaaggacctggccgccctgctgcacgacggcatccccgtggtgagcagcagcagcggcaaggacagcgtgagcggcatcaccagctacgtgagaaccgtgctgtgcgagggcggcgtgccccagagacccgtggtgttcgtgaccagaaagaagctggtgaacgccatccagcagaagctgagcaagctgaagggcgagcccggctgggtgaccatccacggcatggccggctgcggcaagagcgtgctggccgccgaggccgtgagagaccacagcctgctggagggctgcttccccggcggcgtgcactgggtgagcgtgggcaagcaggacaagagcggcctgctgatgaagctgcagaacctgtgcaccagactggaccaggacgagagcttcagccagagactgcccctgaacatcgaggaggccaaggacagactgagaatcctgatgctgagaaagcaccccagaagcctgctgatcctggacgacgtgtgggacagctgggtgctgaaggccttcgacagccagtgccagatcctgctgaccaccagagacaagagcgtgaccgacagcgtgatgggccccaagtacgtggtgcccgtggagagcagcctgggcaaggagaagggcctggagatcctgagcctgttcgtgaacatgaagaaggccgacctgcccgagcaggcccacagcatcatcaaggagtgcaagggcagccccctggtggtgagcctgatcggcgccctgctgagagacttccccaacagatgggagtactacctgaagcagctgcagaacaagcagttcaagagaatcagaaagagcagcagctacgactacgaggccctggacgaggccatgagcatcagcgtggagatgctgagagaggacatcaaggactactacaccgacctgagcatcctgcagaaggacgtgaaggtgcccaccaaggtgctgtgcatcctgtgggacatggagaccgaggaggtggaggacatcctgcaggagttcgtgaacaagagcctgctgttctgcgacagaaacggcaagagcttcagatactacctgcacgacctgcaggtggacttcctgaccgagaagaactgcagccagctgcaggacctgcacaagaagatcatcacccagttccagagataccaccagccccacaccctgagccccgaccaggaggactgcatgtactggtacaacttcctggcctaccacatggccagcgccaagatgcacaaggagctgtgcgccctgatgttcagcctggactggatcaaggccaagaccgagctggtgggccccgcccacctgatccacgagttcgtggagtacagacacatcctggacgagaaggactgcgccgtgagcgagaacttccaggagttcctgagcctgaacggccacctgctgggcagacagcccttccccaacatcgtgcagctgggcctgtgcgagcccgagaccagcgaggtgtaccagcaggccaagctgcaggccaagcaggaggtggacaacggcatgctgtacctggagtggatcaacaagaagaacatcaccaacctgagcagactggtggtgagaccccacaccgacgccgtgtaccacgcctgcttcagcgaggacggccagagaatcgccagctgcggcgccgacaagaccctgcaggtgttcaaggccgagaccggcgagaagctgctggagatcaaggcccacgaggacgaggtgctgtgctgcgccttcagcaccgacgacagattcatcgccacctgcagcgtggacaagaaggtgaagatctggaacagcatgaccggcgagctggtgcacacctacgacgagcacagcgagcaggtgaactgctgccacttcaccaacagcagccaccacctgctgctggccaccggcagcagcgactgcttcctgaagctgtgggacctgaaccagaaggagtgcagaaacaccatgttcggccacaccaacagcgtgaaccactgcagattcagccccgacgacaagctgctggccagctgcagcgccgacggcaccctgaagctgtgggacgccaccagcgccaacgagagaaagagcatcaacgtgaagcagttcttcctgaacctggaggacccccaggaggacatggaggtgatcgtgaagtgctgcagctggagcgccgacggcgccagaatcatggtggccgccaagaacaagatcttcctgtggaacaccgacagcagaagcaaggtggccgactgcagaggccacctgagctgggtgcacggcgtgatgttcagccccgacggcagcagcttcctgaccagcagcgacgaccagaccatcagactgtgggagaccaagaaggtgtgcaagaacagcgccgtgatgctgaagcaggaggtggacgtggtgttccaggagaacgaggtgatggtgctggccgtggaccacatcagaagactgcagctgatcaacggcagaaccggccagatcgactacctgaccgaggcccaggtgagctgctgctgcctgagcccccacctgcagtacatcgccttcggcgacgagaacggcgccatcgagatcctggagctggtgaacaacagaatcttccagagcagattccagcacaagaagaccgtgtggcacatccagttcaccgccgacgagaagaccctgatcagcagcagcgacgacgccgagatccaggtgtggaactggcagctggacaagtgcatcttcctgagaggccaccaggagaccgtgaaggacttcagactgctgaagaacagcagactgctgagctggagcttcgacggcaccgtgaaggtgtggaacatcatcaccggcaacaaggagaaggacttcgtgtgccaccagggcaccgtgctgagctgcgacatcagccacgacgccaccaagttcagcagcaccagcgccgacaagaccgccaagatctggagcttcgacctgctgctgcccctgcacgagctgagaggccacaacggctgcgtgagatgcagcgccttcagcgtggacagcaccctgctggccaccggcgacgacaacggcgagatcagaatctggaacgtgagcaacggcgagctgctgcacctgtgcgcccccctgagcgaggagggcgccgccacccacggcggctgggtgaccgacctgtgcttcagccccgacggcaagatgctgatcagcgccggcggctacatcaagtggtggaacgtggtgaccggcgagagcagccagaccttctacaccaacggcaccaacctgaagaagatccacgtgagccccgacttcaagacctacgtgaccgtggacaacctgggcatcctgtacatcctgcagaccctggagtag

SEQ ID NO: 9374 - DNA, 3585 bp, Artificial Sequence
  Description of Artificial Sequence: Synthetic coding sequence
atggacgccaaggccagaaactgcctgctgcagcacagagaggccctggagaaggacatcaagaccagctacatcatggaccacatgatcagcgacggcttcctgaccatcagcgaggaggagaaggtgagaaacgagcccacccagcagcagagagccgccatgctgatcaagatgatcctgaagaaggacaacgacagctacgtgagcttctacaacgccctgctgcacgagggctacaaggacctggccgccctgctgcacgacggcatccccgtggtgagcagcagcagcgtgagaaccgtgctgtgcgagggcggcgtgccccagagacccgtggtgttcgtgaccagaaagaagctggtgaacgccatccagcagaagctgagcaagctgaagggcgagcccggctgggtgaccatccacggcatggccggctgcggcaagagcgtgctggccgccgaggccgtgagagaccacagcctgctggagggctgcttccccggcggcgtgcactgggtgagcgtgggcaagcaggacaagagcggcctgctgatgaagctgcagaacctgtgcaccagactggaccaggacgagagcttcagccagagactgcccctgaacatcgaggaggccaaggacagactgagaatcctgatgctgagaaagcaccccagaagcctgctgatcctggacgacgtgtgggacagctgggtgctgaaggccttcgacagccagtgccagatcctgctgaccaccagagacaagagcgtgaccgacagcgtgatgggccccaagtacgtggtgcccgtggagagcagcctgggcaaggagaagggcctggagatcctgagcctgttcgtgaacatgaagaaggccgacctgcccgagcaggcccacagcatcatcaaggagtgcaagggcagccccctggtggtgagcctgatcggcgccctgctgagagacttccccaacagatgggagtactacctgaagcagctgcagaacaagcagttcaagagaatcagaaagagcagcagctacgactacgaggccctggacgaggccatgagcatcagcgtggagatgctgagagaggacatcaaggactactacaccgacctgagcatcctgcagaaggacgtgaaggtgcccaccaaggtgctgtgcatcctgtgggacatggagaccgaggaggtggaggacatcctgcaggagttcgtgaacaagagcctgctgttctgcgacagaaacggcaagagcttcagatactacctgcacgacctgcaggtggacttcctgaccgagaagaactgcagccagctgcaggacctgcacaagaagatcatcacccagttccagagataccaccagccccacaccctgagccccgaccaggaggactgcatgtactggtacaacttcctggcctaccacatggccagcgccaagatgcacaaggagctgtgcgccctgatgttcagcctggactggatcaaggccaagaccgagctggtgggccccgcccacctgatccacgagttcgtggagtacagacacatcctggacgagaaggactgcgccgtgagcgagaacttccaggagttcctgagcctgaacggccacctgctgggcagacagcccttccccaacatcgtgcagctgggcctgtgcgagcccgagaccagcgaggtgtaccagcaggccaagctgcaggccaagcaggaggtggacaacggcatgctgtacctggagtggatcaacaagaagaacatcaccaacctgagcagactggtggtgagaccccacaccgacgccgtgtaccacgcctgcttcagcgaggacggccagagaatcgccagctgcggcgccgacaagaccctgcaggtgttcaaggccgagaccggcgagaagctgctggagatcaaggcccacgaggacgaggtgctgtgctgcgccttcagcaccgacgacagattcatcgccacctgcagcgtggacaagaaggtgaagatctggaacagcatgaccggcgagctggtgcacacctacgacgagcacagcgagcaggtgaactgctgccacttcaccaacagcagccaccacctgctgctggccaccggcagcagcgactgcttcctgaagctgtgggacctgaaccagaaggagtgcagaaacaccatgttcggccacaccaacagcgtgaaccactgcagattcagccccgacgacaagctgctggccagctgcagcgccgacggcaccctgaagctgtgggacgccaccagcgccaacgagagaaagagcatcaacgtgaagcagttcttcctgaacctggaggacccccaggaggacatggaggtgatcgtgaagtgctgcagctggagcgccgacggcgccagaatcatggtggccgccaagaacaagatcttcctgtggaacaccgacagcagaagcaaggtggccgactgcagaggccacctgagctgggtgcacggcgtgatgttcagccccgacggcagcagcttcctgaccagcagcgacgaccagaccatcagactgtgggagaccaagaaggtgtgcaagaacagcgccgtgatgctgaagcaggaggtggacgtggtgttccaggagaacgaggtgatggtgctggccgtggaccacatcagaagactgcagctgatcaacggcagaaccggccagatcgactacctgaccgaggcccaggtgagctgctgctgcctgagcccccacctgcagtacatcgccttcggcgacgagaacggcgccatcgagatcctggagctggtgaacaacagaatcttccagagcagattccagcacaagaagaccgtgtggcacatccagttcaccgccgacgagaagaccctgatcagcagcagcgacgacgccgagatccaggtgtggaactggcagctggacaagtgcatcttcctgagaggccaccaggagaccgtgaaggacttcagactgctgaagaacagcagactgctgagctggagcttcgacggcaccgtgaaggtgtggaacatcatcaccggcaacaaggagaaggacttcgtgtgccaccagggcaccgtgctgagctgcgacatcagccacgacgccaccaagttcagcagcaccagcgccgacaagaccgccaagatctggagcttcgacctgctgctgcccctgcacgagctgagaggccacaacggctgcgtgagatgcagcgccttcagcgtggacagcaccctgctggccaccggcgacgacaacggcgagatcagaatctggaacgtgagcaacggcgagctgctgcacctgtgcgcccccctgagcgaggagggcgccgccacccacggcggctgggtgaccgacctgtgcttcagccccgacggcaagatgctgatcagcgccggcggctacatcaagtggtggaacgtggtgaccggcgagagcagccagaccttctacaccaacggcaccaacctgaagaagatccacgtgagccccgacttcaagacctacgtgaccgtggacaacctgggcatcctgtacatcctgcagaccctggagtag

SEQ ID NO: 9375 - DNA, 3618 bp, Artificial Sequence; identical to SEQ ID NO: 9373
  Description of Artificial Sequence: Synthetic coding sequence

SEQ ID NO: 9376 - DNA, 3492 bp, Artificial Sequence; identical to SEQ ID NO: 9372
  Description of Artificial Sequence: Synthetic coding sequence

SEQ ID NO: 9377 - DNA, 3714 bp, Artificial Sequence
  Description of Artificial Sequence: Synthetic coding sequence
atggacgccaaggccagaaactgcctgctgcagcacagagaggccctggagaaggacatcaagaccagctacatcatggaccacatgatcagcgacggcttcctgaccatcagcgaggaggagaaggtgagaaacgagcccacccagcagcagagagccgccatgctgatcaagatgatcctgaagaaggacaacgacagctacgtgagcttctacaacgccctgctgcacgagggctacaaggacctggccgccctgctgcacgacggcatccccgtggtgagcagcagcagcgtgagaaccgtgctgtgcgagggcggcgtgccccagagacccgtggtgttcgtgaccagaaagaagctggtgaacgccatccagcagaagctgagcaagctgaagggcgagcccggctgggtgaccatccacggcatggccggctgcggcaagagcgtgctggccgccgaggccgtgagagaccacagcctgctggagggctgcttccccggcggcgtgcactgggtgagcgtgggcaagcaggacaagagcggcctgctgatgaagctgcagaacctgtgcaccagactggaccaggacgagagcttcagccagagactgcccctgaacatcgaggaggccaaggacagactgagaatcctgatgctgagaaagcaccccagaagcctgctgatcctggacgacgtgtgggacagctgggtgctgaaggccttcgacagccagtgccagatcctgctgaccaccagagacaagagcgtgaccgacagcgtgatgggccccaagtacgtggtgcccgtggagagcagcctgggcaaggagaagggcctggagatcctgagcctgttcgtgaacatgaagaaggccgacctgcccgagcaggcccacagcatcatcaaggagtgcaagggcagccccctggtggtgagcctgatcggcgccctgctgagagacttccccaacagatgggagtactacctgaagcagctgcagaacaagcagttcaagagaatcagaaagagcagcagctacgactacgaggccctggacgaggccatgagcatcagcgtggagatgctgagagaggacatcaaggactactacaccgacctgagcatcctgcagaaggacgtgaaggtgcccaccaaggtgctgtgcatcctgtgggacatggagaccgaggaggtggaggacatcctgcaggagttcgtgaacaagagcctgctgttctgcgacagaaacggcaagagcttcagatactacctgcacgacctgcaggtggacttcctgaccgagaagaactgcagccagctgcaggacctgcacaagaagatcatcacccagttccagagataccaccagccccacaccctgagccccgaccaggaggactgcatgtactggtacaacttcctggcctaccacatggccagcgccaagatgcacaaggagctgtgcgccctgatgttcagcctggactggatcaaggccaagaccgagctggtgggccccgcccacctgatccacgagttcgtggagtacagacacatcctggacgagaaggactgcgccgtgagcgagaacttccaggagttcctgagcctgaacggccacctgctgggcagacagcccttccccaacatcgtgcagctgggcctgtgcgagcccgagaccagcgaggtgtaccagcaggccaagctgcaggccaagcaggaggtggacaacggcatgctgtacctggagtggatcaacaagaagaacatcaccaacctgagcagactggtggtgagaccccacaccgacgccgtgtaccacgcctgcttcagcgaggacggccagagaatcgccagctgcggcgccgacaagaccctgcaggtgttcaaggccgagaccggcgagaagctgctggagatcaaggcccacgaggacgaggtgctgtgctgcgccttcagcaccgacgacagattcatcgccacctgcagcgtggacaagaaggtgaagatctggaacagcatgaccggcgagctggtgcacacctacgacgagcacagcgagcaggtgaactgctgccacttcaccaacagcagccaccacctgctgctggccaccggcagcagcgactgcttcctgaagctgtgggacctgaaccagaaggagtgcagaaacaccatgttcggccacaccaacagcgtgaaccactgcagattcagccccgacgacaagctgctggccagctgcagcgccgacggcaccctgaagctgtgggacgccaccagcgccaacgagagaaagagcatcaacgtgaagcagttcttcctgaacctggaggacccccaggaggacatggaggtgatcgtgaagtgctgcagctggagcgccgacggcgccagaatcatggtggccgccaagaacaagatcttcctgttcgacatccacaccagcggcctgctgggcgagatccacaccggccaccacagcaccatccagtactgcgacttcagcccccagaaccacctggccgtggtggccctgagccagtactgcgtggagctgtggaacaccgacagcagaagcaaggtggccgactgcagaggccacctgagctgggtgcacggcgtgatgttcagccccgacggcagcagcttcctgaccagcagcgacgaccagaccatcagactgtgggagaccaagaaggtgtgcaagaacagcgccgtgatgctgaagcaggaggtggacgtggtgttccaggagaacgaggtgatggtgctggccgtggaccacatcagaagactgcagctgatcaacggcagaaccggccagatcgactacctgaccgaggcccaggtgagctgctgctgcctgagcccccacctgcagtacatcgccttcggcgacgagaacggcgccatcgagatcctggagctggtgaacaacagaatcttccagagcagattccagcacaagaagaccgtgtggcacatccagttcaccgccgacgagaagaccctgatcagcagcagcgacgacgccgagatccaggtgtggaactggcagctggacaagtgcatcttcctgagaggccaccaggagaccgtgaaggacttcagactgctgaagaacagcagactgctgagctggagcttcgacggcaccgtgaaggtgtggaacatcatcaccggcaacaaggagaaggacttcgtgtgccaccagggcaccgtgctgagctgcgacatcagccacgacgccaccaagttcagcagcaccagcgccgacaagaccgccaagatctggagcttcgacctgctgctgcccctgcacgagctgagaggccacaacggctgcgtgagatgcagcgccttcagcgtggacagcaccctgctggccaccggcgacgacaacggcgagatcagaatctggaacgtgagcaacggcgagctgctgcacctgtgcgcccccctgagcgaggagggcgccgccacccacggcggctgggtgaccgacctgtgcttcagccccgacggcaagatgctgatcagcgccggcggctacatcaagtggtggaacgtggtgaccggcgagagcagccagaccttctacaccaacggcaccaacctgaagaagatccacgtgagccccgacttcaagacctacgtgaccgtggacaacctgggcatcctgtacatcctgcagaccctggagtag

SEQ ID NO: 9378 - DNA, 3747 bp, Artificial Sequence
  Description of Artificial Sequence: Synthetic coding sequence
atggacgccaaggccagaaactgcctgctgcagcacagagaggccctggagaaggacatcaagaccagctacatcatggaccacatgatcagcgacggcttcctgaccatcagcgaggaggagaaggtgagaaacgagcccacccagcagcagagagccgccatgctgatcaagatgatcctgaagaaggacaacgacagctacgtgagcttctacaacgccctgctgcacgagggctacaaggacctggccgccctgctgcacgacggcatccccgtggtgagcagcagcagcggcaaggacagcgtgagcggcatcaccagctacgtgagaaccgtgctgtgcgagggcggcgtgccccagagacccgtggtgttcgtgaccagaaagaagctggtgaacgccatccagcagaagctgagcaagctgaagggcgagcccggctgggtgaccatccacggcatggccggctgcggcaagagcgtgctggccgccgaggccgtgagagaccacagcctgctggagggctgcttccccggcggcgtgcactgggtgagcgtgggcaagcaggacaagagcggcctgctgatgaagctgcagaacctgtgcaccagactggaccaggacgagagcttcagccagagactgcccctgaacatcgaggaggccaaggacagactgagaatcctgatgctgagaaagcaccccagaagcctgctgatcctggacgacgtgtgggacagctgggtgctgaaggccttcgacagccagtgccagatcctgctgaccaccagagacaagagcgtgaccgacagcgtgatgggccccaagtacgtggtgcccgtggagagcagcctgggcaaggagaagggcctggagatcctgagcctgttcgtgaacatgaagaaggccgacctgcccgagcaggcccacagcatcatcaaggagtgcaagggcagccccctggtggtgagcctgatcggcgccctgctgagagacttccccaacagatgggagtactacctgaagcagctgcagaacaagcagttcaagagaatcagaaagagcagcagctacgactacgaggccctggacgaggccatgagcatcagcgtggagatgctgagagaggacatcaaggactactacaccgacctgagcatcctgcagaaggacgtgaaggtgcccaccaaggtgctgtgcatcctgtgggacatggagaccgaggaggtggaggacatcctgcaggagttcgtgaacaagagcctgctgttctgcgacagaaacggcaagagcttcagatactacctgcacgacctgcaggtggacttcctgaccgagaagaactgcagccagctgcaggacctgcacaagaagatcatcacccagttccagagataccaccagccccacaccctgagccccgaccaggaggactgcatgtactggtacaacttcctggcctaccacatggccagcgccaagatgcacaaggagctgtgcgccctgatgttcagcctggactggatcaaggccaagaccgagctggtgggccccgcccacctgatccacgagttcgtggagtacagacacatcctggacgagaaggactgcgccgtgagcgagaacttccaggagttcctgagcctgaacggccacctgctgggcagacagcccttccccaacatcgtgcagctgggcctgtgcgagcccgagaccagcgaggtgtaccagcaggccaagctgcaggccaagcaggaggtggacaacggcatgctgtacctggagtggatcaacaagaagaacatcaccaacctgagcagactggtggtgagaccccacaccgacgccgtgtaccacgcctgcttcagcgaggacggccagagaatcgccagctgcggcgccgacaagaccctgcaggtgttcaaggccgagaccggcgagaagctgctggagatcaaggcccacgaggacgaggtgctgtgctgcgccttcagcaccgacgacagattcatcgccacctgcagcgtggacaagaaggtgaagatctggaacagcatgaccggcgagctggtgcacacctacgacgagcacagcgagcaggtgaactgctgccacttcaccaacagcagccaccacctgctgctggccaccggcagcagcgactgcttcctgaagctgtgggacctgaaccagaaggagtgcagaaacaccatgttcggccacaccaacagcgtgaaccactgcagattcagccccgacgacaagctgctggccagctgcagcgccgacggcaccctgaagctgtgggacgccaccagcgccaacgagagaaagagcatcaacgtgaagcagttcttcctgaacctggaggacccccaggaggacatggaggtgatcgtgaagtgctgcagctggagcgccgacggcgccagaatcatggtggccgccaagaacaagatcttcctgttcgacatccacaccagcggcctgctgggcgagatccacaccggccaccacagcaccatccagtactgcgacttcagcccccagaaccacctggccgtggtggccctgagccagtactgcgtggagctgtggaacaccgacagcagaagcaaggtggccgactgcagaggccacctgagctgggtgcacggcgtgatgttcagccccgacggcagcagcttcctgaccagcagcgacgaccagaccatcagactgtgggagaccaagaaggtgtgcaagaacagcgccgtgatgctgaagcaggaggtggacgtggtgttccaggagaacgaggtgatggtgctggccgtggaccacatcagaagactgcagctgatcaacggcagaaccggccagatcgactacctgaccgaggcccaggtgagctgctgctgcctgagcccccacctgcagtacatcgccttcggcgacgagaacggcgccatcgagatcctggagctggtgaacaacagaatcttccagagcagattccagcacaagaagaccgtgtggcacatccagttcaccgccgacgagaagaccctgatcagcagcagcgacgacgccgagatccaggtgtggaactggcagctggacaagtgcatcttcctgagaggccaccaggagaccgtgaaggacttcagactgctgaagaacagcagactgctgagctggagcttcgacggcaccgtgaaggtgtggaacatcatcaccggcaacaaggagaaggacttcgtgtgccaccagggcaccgtgctgagctgcgacatcagccacgacgccaccaagttcagcagcaccagcgccgacaagaccgccaagatctggagcttcgacctgctgctgcccctgcacgagctgagaggccacaacggctgcgtgagatgcagcgccttcagcgtggacagcaccctgctggccaccggcgacgacaacggcgagatcagaatctggaacgtgagcaacggcgagctgctgcacctgtgcgcccccctgagcgaggagggcgccgccacccacggcggctgggtgaccgacctgtgcttcagccccgacggcaagatgctgatcagcgccggcggctacatcaagtggtggaacgtggtgaccggcgagagcagccagaccttctacaccaacggcaccaacctgaagaagatccacgtgagccccgacttcaagacctacgtgaccgtggacaacctgggcatcctgtacatcctgcagaccctggagtag

SEQ ID NO: 9379 - DNA, 1017 bp, Artificial Sequence; identical to SEQ ID NO: 9371
  Description of Artificial Sequence: Synthetic coding sequence

SEQ ID NO: 9380 - DNA, 2025 bp, Artificial Sequence
  Description of Artificial Sequence: Synthetic coding sequence
atgcccagctacaccgtgaccgtggccaccggcagccagtggttcgccggcaccgacgactacatctacctgagcctggtgggcagcgccggctgcagcgagaagcacctgctggacaagcccttctacaacgacttcgagagaggcgccgtggacagctacgacgtgaccgtggacgaggagctgggcgagatccagctggtgagaatcgagaagagaaagtactggctgaacgacgactggtacctgaagtacatcaccctgaagaccccccacggcgactacatcgagttcccctgctacagatggatcaccggcgacgtggaggtggtgctgagagacggcagagccaagctggccagagacgaccagatccacatcctgaagcagcacagaagaaaggagctggagaccagacagaagcagtacagatggatggagtggaaccccggcttccccctgagcatcgacgccaagtgccacaaggacctgcccagagacatccagttcgacagcgagaagggcgtggacttcgtgctgaactacagcaaggccatggagaacctgttcatcaacagattcatgcacatgttccagagcagctggaacgacttcgccgacttcgagaagatcttcgtgaagatcagcaacaccatcagcgagagagtgatgaaccactggcaggaggacctgatgttcggctaccagttcctgaacggctgcaaccccgtgctgatcagaagatgcaccgagctgcccgagaagctgcccgtgaccaccgagatggtggagtgcagcctggagagacagctgagcctggagcaggaggtgcagcagggcaacatcttcatcgtggacttcgagctgctggacggcatcgacgccaacaagaccgacccctgcaccctgcagttcctggccgcccccatctgcctgctgtacaagaacctggccaacaagatcgtgcccatcgccatccagctgaaccagatccccggcgacgagaaccccatcttcctgcccagcgacgccaagtacgactggctgctggccaagatctgggtgagaagcagcgacttccacgtgcaccagaccatcacccacctgctgagaacccacctggtgagcgaggtgttcggcatcgccatgtacagacagctgcccgccgtgcaccccatcttcaagctgctggtggcccacgtgagattcaccatcgccatcaacaccaaggccagagagcagctgatctgcgagtgcggcctgttcgacaaggccaacgccaccggcggcggcggccacgtgcagatggtgcagagagccatgaaggacctgacctacgccagcctgtgcttccccgaggccatcaaggccagaggcatggagagcaaggaggacatcccctactacttctacagagacgacggcctgctggtgtgggaggccatcagaaccttcaccgccgaggtggtggacatctactacgagggcgaccaggtggtggaggaggaccccgagctgcaggacttcgtgaacgacgtgtacgtgtacggcatgagaggcagaaagagcagcggcttccccaagagcgtgaagagcagagagcagctgagcgagtacctgaccgtggtgatcttcaccgccagcgcccagcacgccgccgtgaacttcggccagtacgactggtgcagctggatccccaacgccccccccaccatgagagcccccccccccaccgccaagggcgtggtgaccatcgagcagatcgtggacaccctgcccgacagaggcagaagctgctggcacctgggcgccgtgtgggccctgagccagttccaggagaacgagctgttcctgggcatgtaccccgaggagcacttcatcgagaagcccgtgaaggaggccatggccagattcagaaagaacctggaggccatcgtgagcgtgatcgccgagagaaacaagaagaagcagctgccctactactacctgagccccgacagaatccccaacagcgtggccatctag

SEQ ID NO: 9381 - DNA, 1854 bp, Artificial Sequence
  Description of Artificial Sequence: Synthetic coding sequence
atgcccagctacaccgtgaccgtggccaccggcagccagtggttcgccggcaccgacgactacatctacctgagcctggtgggcagcgccggctgcagcgagaagcacctgctggacaagcccttctacaacgacttcgagagaggcgccgtggacagctacgacgtgaccgtggacgaggagctgggcgagatccagctggtgagaatcgagaagagaaagtactggctgaacgacgactggtacctgaagtacatcaccctgaagaccccccacggcgactacatcgagttcccctgctacagatggatcaccggcgacgtggaggtggtgctgagagacggcagagccaagctggccagagacgaccagatccacatcctgaagcagcacagaagaaaggagctggagaccagacagaagcagtacagatggatggagtggaaccccggcttccccctgagcatcgacgccaagtgccacaaggacctgcccagagacatccagttcgacagcgagaagggcgtggacttcgtgctgaactacagcaaggccatggagaacctgttcatcaacagattcatgcacatgttccagagcagctggaacgacttcgccgacttcgagaagatcttcgtgaagatcagcaacaccatcagcgagagagtgatgaaccactggcaggaggacctgatgttcggctaccagttcctgaacggctgcaaccccgtgctgatcagaagatgcaccgagctgcccgagaagctgcccgtgaccaccgagatggtggagtgcagcctggagagacagctgagcctggagcaggaggtgcagcagggcaacatcttcatcgtggacttcgagctgctggacggcatcgacgccaacaagaccgacccctgcaccctgcagttcctggccgcccccatctgcctgctgtacaagaacctggccaacaagatcgtgcccatcgccatccagctgaaccagatccccggcgacgagaaccccatcttcctgcccagcgacgccaagtacgactggctgctggccaagatctgggtgagaagcagcgacttccacgtgcaccagaccatcacccacctgctgagaacccacctggtgagcgaggtgttcggcatcgccatgtacagacagctgcccgccgtgcaccccatcttcaagctgctggtggcccacgtgagattcaccatcgccatcaacaccaaggccagagagcagctgatctgcgagtgcggcctgttcgacaaggccaacgccaccggcggcggcggccacgtgcagatggtgcagagagccatgaaggacctgacctacgccagcctgtgcttccccgaggccatcaaggccagaggcatggagagcaaggaggacatcccctactacttctacagagacgacggcctgctggtgtgggaggccatcagaaccttcaccgccgaggtggtggacatctactacgagggcgaccaggtggtggaggaggaccccgagctgcaggacttcgtgaacgacgtgtacgtgtacggcatgagaggcagaaagagcagcggcttccccaagagcgtgaagagcagagagcagctgagcgagtacctgaccgtggtgatcttcaccgccagcgcccagcacgccgccgtgaacttcggccagctgttcctgggcatgtaccccgaggagcacttcatcgagaagcccgtgaaggaggccatggccagattcagaaagaacctggaggccatcgtgagcgtgatcgccgagagaaacaagaagaagcagctgccctactactacctgagccccgacagaatccccaacagcgtggccatctag

SEQ ID NO: 9382 - DNA, 2511 bp, Artificial Sequence
  Description of Artificial Sequence: Synthetic coding sequence
atgcacgcccagagacagttcgtggtggccgccgtgagagccgaggtgagaagacacgaggtggccaagcaggccctgaacagactgagaaagctggccgagagagtggacgaccccgagctgcaggacagcatccaggccagcctggacagcatcagagaggccgtgatcaacagccaggagtggaccctgagcagaagcatccccgagctgagactgggcgtgctgggcgacgccagaagcggcaagagcagcctgatccacagattcctgaccggcagctaccaggtgctggagaagaccgagagcgagcagtacaagaaggagatgctggtggacggccagacccacctggtgctgatcagagaggaggccggcgcccccgacgccaagttcagcggctgggccgacgccgtgatcttcgtgttcagcctggaggacgagaacagcttccaggccgtgagcagactgcacggccagctgagcagcctgagaggcgagggcagaggcggcctggccctggccctggtgggcacccaggacagaatcagcgccagcagccccagagtggtgggcgacgccagagccagagccctgtgcgccgacatgaagagatgcagctactacgagacctgcgccacctacggcctgaacgtggacagagtgttccaggaggtggcccagaaggtggtgaccctgagaaagcagcagcagctgctggccgcctgcaagagcctgcccagcagccccagccacagcgccgccagcacccccgtggccggccaggccagcaacggcggccacaccagcgactacagcagcagcctgcccagcagccccaacgtgggccacagagagctgagagccgaggccgccgccgtggccggcctgagcacccccggcagcctgcacagagccgccaagagaagaaccagcctgttcgccaacagaagaggcagcgacagcgagaagagaagcctggacagcagaggcgagaccaccggcagcggcagagccatccccatcaagcagagcttcctgctgaagagaagcggcaacagcctgaacaaggagtggaagaagaagtacgtgaccctgagcagcaacggcttcctgctgtaccaccccagcatcaacgactacatccacagcacccacggcaaggagatggacctgctgagaaccaccgtgaaggtgcccggcaagagaccccccagagccatcagcgccttcggccccagcgccagcatcaacggcctggtgaaggacatgagcaccgtgcagatgggcgagggcctggaggccaccacccccatgcccagccccagccccagccccagcagcctgcagcccccccccgaccagaccagcaagcacctgctgaagcccgacagaaacctggccagagccctgagcaccgactgcacccccagcggcgacctgagccccctgagcagagagcccccccccagccccatggtgaagaagcagagaagaaagaagctgaccacccccagcaagaccgagggcagcgccggccaggccgaggaggagaacttcgagttcctgatcgtgagcagcaccggccagacctggcacttcgaggccgccagcttcgaggagagagacgcctgggtgcaggccatcgagagccagatcctggccagcctgcagtgctgcgagagcagcaaggtgaagctgagaaccgacagccagagcgaggccgtggccatccaggccatcagaaacgccaagggcaacagcatctgcgtggactgcggcgcccccaaccccacctgggccagcctgaacctgggcgccctgatctgcatcgagtgcagcggcatccacagaaacctgggcacccacctgagcagagtgagaagcctggacctggacgactggcccagagagctgaccctggtgctgaccgccatcggcaacgacaccgccaacagagtgtgggagagcgacaccagaggcagagccaagcccagcagagacagcagcagagaggagagagagagctggatcagagccaagtacgagcagctgctgttcctggcccccctgagcaccagcgaggagcccctgggcagacagctgtgggccgccgtgcaggcccaggacgtggccaccgtgctgctgctgctggcccacgccagacacggccccctggacaccagcgtggaggacccccagctgagaagccccctgcacctggccgccgagctggcccacgtggtgatcacccagctgctgctgtggtacggcgccgacgtggccgccagagacgcccagggcagaaccgccctgttctacgccagacaggccggcagccagctgtgcgccgacatcctgctgcagcacggctgccccggcgagggcggcagcgccgccaccacccccagcgccgccaccacccccagcatcaccgccacccccagccccagaagaagaagcagcgccgccagcgtgggcagagccgacgcccccgtggccctggtgtag

SEQ ID NO: 9383 - DNA, 3579 bp, Artificial Sequence
  Description of Artificial Sequence: Synthetic coding sequence
atgagcagaggcgccggcgccctgcagagaagaaccaccacctacctgatcagcctgaccctggtgaagctggagagcgtgcccccccccccccccagccccagcgccgccgccgccggcgccgccggcgccagaggcagcgagaccggcgaccccggcagccccagaggcgccgaggagcccggcaagaagagacacgagagactgttccacagacaggacgccctgtggatcagcaccagcagcgccggcaccggcggcgccgagccccccgccctgagccccgcccccgccagccccgccagacccgtgagccccgcccccggcagaagactgagcctgtgggccgtgccccccggcccccccctgagcggcggcctgagccccgaccccaagcccggcggcgcccccaccagcagcagaagacccctgctgagcagccccagctggggcggccccgagcccgagggcagagccggcggcggcatccccggcagcagcagcccccaccccggcaccggcagcagaagactgaaggtggccccccccccccccgcccccaagccctgcaagaccgtgaccaccagcggcgccaaggccggcggcggcaagggcgccggcagcagactgagctggcccgagagcgagggcaagcccagagtgaagggcagcaagagcagcgccggcaccggcgccagcgtgagcgccgccgccaccgccgccgccgccggcggcggcggcagcaccgccagcaccagcggcggcgtgggcgccggcgccggcgccagaggcaagctgagccccagaaagggcaagagcaagaccctggacaacagcgacctgcaccccggcccccccgccggcagccccccccccctgaccctgccccccacccccagccccgccaccgccgtgaccgccgccagcgcccagccccccggccccgccccccccatcaccctggagccccccgcccccggcctgaagagaggcagagagggcggcagagccagcaccagagacagaaagatgctgaagttcatcagcggcatcttcaccaagagcaccggcggcccccccggcagcggccccctgcccggcccccccagcctgagcagcggcagcggcagcagagagctgctgggcgccgagctgagagccagccccaaggccgtgatcaacagccaggagtggaccctgagcagaagcatccccgagctgagactgggcgtgctgggcgacgccagaagcggcaagagcagcctgatccacagattcctgaccggcagctaccaggtgctggagaagaccgagagcgagcagtacaagaaggagatgctggtggacggccagacccacctggtgctgatcagagaggaggccggcgcccccgacgccaagttcagcggctgggccgacgccgtgatcttcgtgttcagcctggaggacgagaacagcttccaggccgtgagcagactgcacggccagctgagcagcctgagaggcgagggcagaggcggcctggccctggccctggtgggcacccaggacagaatcagcgccagcagccccagagtggtgggcgacgccagagccagagccctgtgcgccgacatgaagagatgcagctactacgagacctgcgccacctacggcctgaacgtggacagagtgttccaggaggtggcccagaaggtggtgaccctgagaaagcagcagcagctgctggccgcctgcaagagcctgcccagcagccccagccacagcgccgccagcacccccgtggccggccaggccagcaacggcggccacaccagcgactacagcagcagcctgcccagcagccccaacgtgggccacagagagctgagagccgaggccgccgccgtggccggcctgagcacccccggcagcctgcacagagccgccaagagaagaaccagcctgttcgccaacagaagaggcagcgacagcgagaagagaagcctggacagcagaggcgagaccaccggcagcggcagagccatccccatcaagcagagcttcctgctgaagagaagcggcaacagcctgaacaaggagtggaagaagaagtacgtgaccctgagcagcaacggcttcctgctgtaccaccccagcatcaacgactacatccacagcacccacggcaaggagatggacctgctgagaaccaccgtgaaggtgcccggcaagagaccccccagagccatcagcgccttcggccccagcgccagcatcaacggcctggtgaaggacatgagcaccgtgcagatgggcgagggcctggaggccaccacccccatgcccagccccagccccagccccagcagcctgcagcccccccccgaccagaccagcaagcacctgctgaagcccgacagaaacctggccagagccctgagcaccgactgcacccccagcggcgacctgagccccctgagcagagagcccccccccagccccatggtgaagaagcagagaagaaagaagctgaccacccccagcaagaccgagggcagcgccggccaggccgaggccaagagaaagatgtggaagctgaagagcttcggcagcctgagaaacatctacaaggccgaggagaacttcgagttcctgatcgtgagcagcaccggccagacctggcacttcgaggccgccagcttcgaggagagagacgcctgggtgcaggccatcgagagccagatcctggccagcctgcagtgctgcgagagcagcaaggtgaagctgagaaccgacagccagagcgaggccgtggccatccaggccatcagaaacgccaagggcaacagcatctgcgtggactgcggcgcccccaaccccacctgggccagcctgaacctgggcgccctgatctgcatcgagtgcagcggcatccacagaaacctgggcacccacctgagcagagtgagaagcctggacctggacgactggcccagagagctgaccctggtgctgaccgccatcggcaacgacaccgccaacagagtgtgggagagcgacaccagaggcagagccaagcccagcagagacagcagcagagaggagagagagagctggatcagagccaagtacgagcagctgctgttcctggcccccctgagcaccagcgaggagcccctgggcagacagctgtgggccgccgtgcaggcccaggacgtggccaccgtgctgctgctgctggcccacgccagacacggccccctggacaccagcgtggaggacccccagctgagaagccccctgcacctggccgccgagctggcccacgtggtgatcacccagctgctgctgtggtacggcgccgacgtggccgccagagacgcccagggcagaaccgccctgttctacgccagacaggccggcagccagctgtgcgccgacatcctgctgcagcacggctgccccggcgagggcggcagcgccgccaccacccccagcgccgccaccacccccagcatcaccgccacccccagccccagaagaagaagcagcgccgccagcgtgggcagagccgacgcccccgtggccctggtgtag

SEQ ID NO: 9384 - DNA, 1185 bp, Artificial Sequence
  Description of Artificial Sequence: Synthetic coding sequence
atggacagccagggcagaaaggtggtggtgtgcgacaacggcaccggcttcgtgaagtgcggctacgccggcagcaacttccccgagcacatcttccccgccctggtgggcagacccatcatcagaagcaccaccaaggtgggcaacatcgagatcaaggacctgatggtgggcgacgaggccagcgagctgagaagcatgctggaggtgaactaccccatggagaacggcatcgtgagaaactgggacgacatgaagcacctgtgggactacaccttcggccccgagaagctgaacatcgacaccagaaactgcaagatcctgctgaccgagccccccatgaaccccaccaagaacagagagaagatcgtggaggtgatgttcgagacctaccagttcagcggcgtgtacgtggccatccaggccgtgctgaccctgtacgcccagggcctgctgaccggcgtggtggtggacagcggcgacggcgtgacccacatctgccccgtgtacgagggcttcagcctgccccacctgaccagaagactggacatcgccggcagagacatcaccagatacctgatcaagctgctgctgctgagaggctacgccttcaaccacagcgccgacttcgagaccgtgagaatgatcaaggagaagctgtgctacgtgggctacaacatcgagcaggagcagaagctggccctggagaccaccgtgctggtggagagctacaccctgcccgacggcagaatcatcaaggtgggcggcgagagattcgaggcccccgaggccctgttccagccccacctgatcaacgtggagggcgtgggcgtggccgagctgctgttcaacaccatccaggccgccgacatcgacaccagaagcgagttctacaagcacatcgtgctgagcggcggcagcaccatgtaccccggcctgcccagcagactggagagagagctgaagcagctgtacctggagagagtgctgaagggcgacgtggagaagctgagcaagttcaagatcagaatcgaggacccccccagaagaaagcacatggtgttcctgggcggcgccgtgctggccgacatcatgaaggacaaggacaacttctggatgaccagacaggagtaccaggagaagggcgtgagagtgctggagaagctgggcgtgaccgtgagatag

SEQ ID NO: 9385 - DNA, 1200 bp, Artificial Sequence
  Description of Artificial Sequence: Synthetic coding sequence
atggacagccagggcagaaaggtggtggtgtgcgacaacggcaccggcttcgtgaagtgcggctacgccggcagcaacttccccgagcacatcttccccgccctggtgggcagacccatcatcagaagcaccaccaaggtgggcaacatcgagatcaagaacaacaagaagatggacctgatggtgggcgacgaggccagcgagctgagaagcatgctggaggtgaactaccccatggagaacggcatcgtgagaaactgggacgacatgaagcacctgtgggactacaccttcggccccgagaagctgaacatcgacaccagaaactgcaagatcctgctgaccgagccccccatgaaccccaccaagaacagagagaagatcgtggaggtgatgttcgagacctaccagttcagcggcgtgtacgtggccatccaggccgtgctgaccctgtacgcccagggcctgctgaccggcgtggtggtggacagcggcgacggcgtgacccacatctgccccgtgtacgagggcttcagcctgccccacctgaccagaagactggacatcgccggcagagacatcaccagatacctgatcaagctgctgctgctgagaggctacgccttcaaccacagcgccgacttcgagaccgtgagaatgatcaaggagaagctgtgctacgtgggctacaacatcgagcaggagcagaagctggccctggagaccaccgtgctggtggagagctacaccctgcccgacggcagaatcatcaaggtgggcggcgagagattcgaggcccccgaggccctgttccagccccacctgatcaacgtggagggcgtgggcgtggccgagctgctgttcaacaccatccaggccgccgacatcgacaccagaagcgagttctacaagcacatcgtgctgagcggcggcagcaccatgtaccccggcctgcccagcagactggagagagagctgaagcagctgtacctggagagagtgctgaagggcgacgtggagaagctgagcaagttcaagatcagaatcgaggacccccccagaagaaagcacatggtgttcctgggcggcgccgtgctggccgacatcatgaaggacaaggacaacttctggatgaccagacaggagtaccaggagaagggcgtgagagtgctggagaagctgggcgtgaccgtgagatag

SEQ ID NO: 9386 - DNA, 1020 bp, Artificial Sequence
  Description of Artificial Sequence: Synthetic coding sequence
atggtgggcgacgaggccagcgagctgagaagcatgctggaggtgaactaccccatggagaacggcatcgtgagaaactgggacgacatgaagcacctgtgggactacaccttcggccccgagaagctgaacatcgacaccagaaactgcaagatcctgctgaccgagccccccatgaaccccaccaagaacagagagaagatcgtggaggtgatgttcgagacctaccagttcagcggcgtgtacgtggccatccaggccgtgctgaccctgtacgcccagggcctgctgaccggcgtggtggtggacagcggcgacggcgtgacccacatctgccccgtgtacgagggcttcagcctgccccacctgaccagaagactggacatcgccggcagagacatcaccagatacctgatcaagctgctgctgctgagaggctacgccttcaaccacagcgccgacttcgagaccgtgagaatgatcaaggagaagctgtgctacgtgggctacaacatcgagcaggagcagaagctggccctggagaccaccgtgctggtggagagctacaccctgcccgacggcagaatcatcaaggtgggcggcgagagattcgaggcccccgaggccctgttccagccccacctgatcaacgtggagggcgtgggcgtggccgagctgctgttcaacaccatccaggccgccgacatcgacaccagaagcgagttctacaagcacatcgtgctgagcggcggcagcaccatgtaccccggcctgcccagcagactggagagagagctgaagcagctgtacctggagagagtgctgaagggcgacgtggagaagctgagcaagttcaagatcagaatcgaggacccccccagaagaaagcacatggtgttcctgggcggcgccgtgctggccgacatcatgaaggacaaggacaacttctggatgaccagacaggagtaccaggagaagggcgtgagagtgctggagaagctgggcgtgaccgtgagatag

SEQ ID NO: 9387 - DNA, 918 bp, Artificial Sequence
  Description of Artificial Sequence: Synthetic coding sequence
atggtgggcgacgaggccagcgagctgagaagcatgctggaggtgaactaccccatggagaacggcatcgtgagaaactgggacgacatgaagcacctgtgggactacaccttcggccccgagaagctgaacatcgacaccagaaactgcaagatcctgctgaccgagccccccatgaaccccaccaagaacagagagaagatcgtggaggtgatgttcgagacctaccagttcagcggcgtgtacgtggccatccaggccgtgctgaccctgtacgcccagggcctgctgaccggcgtggtggtggacagcggcgacggcgtgacccacatctgccccgtgtacgagggcttcagcctgccccacctgaccagaagactggacatcgccggcagagacatcaccagatacctgatcaagctgctgctgctgagaggctacgccttcaaccacagcgccgacttcgagaccgtgagaatgatcaaggagaagctgtgctacgtgggctacaacatcgagcaggagcagaagctggccctggagaccaccgtgctggtggagagctacaccctgcccgacggcagaatcatcaaggtgggcggcgagagattcgaggcccccgaggccctgttccagccccacctgatcaacgtggagggcgtgggcgtggccgagctgctgttcaacaccatccaggccgccgacatcgacaccagaagcgagttctacaagcacatcgtgctgagcggcggcagcaccatgtaccccggcctgcccagcagactggagagagagctgaagcagctgtacctggagagagtgctgaagggcgacgtggagaagctgagcgtgagcatcagcaagagcaccatcaccaacatcctgctgaagggctacaccgtggtgtgcgagagctag

SEQ ID NO: 9388 - DNA, 1257 bp, Artificial Sequence
  Description of Artificial Sequence: Synthetic coding sequence
atggccggcagactgcccgcctgcgtggtggactgcggcaccggctacaccaagctgggctacgccggcaacaccgagccccagttcatcatccccagctgcatcgccatcaaggagagcgccaaggtgggcgaccaggcccagagaagagtgatgaagggcgtggacgacctggacttcttcatcggcgacgaggccatcgagaagcccacctacgccaccaagtggcccatcagacacggcatcgtggaggactgggacctgatggagagattcatggagcaggtgatcttcaagtacctgagagccgagcccgaggaccactacttcctgctgaccgagccccccctgaacacccccgagaacagagagtacaccgccgagatcatgttcgagagcttcaacgtgcccggcctgtacatcgccgtgcaggccgtgctggccctggccgccagctggaccagcagacaggtgggcgagagaaccctgaccggcaccgtgatcgacagcggcgacggcgtgacccacgtgatccccgtggccgagggctacgtgatcggcagctgcatcaagcacatccccatcgccggcagagacatcacctacttcatccagcagctgctgagagacagagaggtgggcatcccccccgagcagagcctggagaccgccaaggccgtgaaggagagatacagctacgtgtgccccgacctggtgaaggagttcaacaagtacgacaccgacggcagcaagtggatcaagcagtacaccggcatcaacgccatcagcaagaaggagttcagcatcgacgtgggctacgagagattcctgggccccgagatcttcttccaccccgagttcgccaaccccgacttcacccagcccatcagcgaggtggtggacgaggtgatccagaactgccccatcgacgtgagaagacccctgtacaagaacatcgtgctgagcggcggcagcaccatgttcagagacttcggcagaagactgcagagagacctgaagagaaccgtggacgccagactgaagctgagcgaggagctgagcggcggcagactgaagcccaagcccatcgacgtgcaggtgatcacccaccacatgcagagatacgccgtgtggttcggcggcagcatgctggccagcacccccgagttctaccaggtgtgccacaccaagaaggactacgaggagatcggccccagcatctgcagacacaaccccgtgttcggcgtgatgagctag

SEQ ID NO: 9389 - DNA, 1104 bp, Artificial Sequence
  Description of Artificial Sequence: Synthetic coding sequence
atgaagggcgtggacgacctggacttcttcatcggcgacgaggccatcgagaagcccacctacgccaccaagtggcccatcagacacggcatcgtggaggactgggacctgatggagagattcatggagcaggtgatcttcaagtacctgagagccgagcccgaggaccactacttcctgctgaccgagccccccctgaacacccccgagaacagagagtacaccgccgagatcatgttcgagagcttcaacgtgcccggcctgtacatcgccgtgcaggccgtgctggccctggccgccagctggaccagcagacaggtgggcgagagaaccctgaccggcaccgtgatcgacagcggcgacggcgtgacccacgtgatccccgtggccgagggctacgtgatcggcagctgcatcaagcacatccccatcgccggcagagacatcacctacttcatccagcagctgctgagagacagagaggtgggcatcccccccgagcagagcctggagaccgccaaggccgtgaaggagagatacagctacgtgtgccccgacctggtgaaggagttcaacaagtacgacaccgacggcagcaagtggatcaagcagtacaccggcatcaacgccatcagcaagaaggagttcagcatcgacgtgggctacgagagattcctgggccccgagatcttcttccaccccgagttcgccaaccccgacttcacccagcccatcagcgaggtggtggacgaggtgatccagaactgccccatcgacgtgagaagacccctgtacaagaacatcgtgctgagcggcggcagcaccatgttcagagacttcggcagaagactgcagagagacctgaagagaaccgtggacgccagactgaagctgagcgaggagctgagcggcggcagactgaagcccaagcccatcgacgtgcaggtgatcacccaccacatgcagagatacgccgtgtggttcggcggcagcatgctggccagcacccccgagttctaccaggtgtgccacaccaagaaggactacgaggagatcggccccagcatctgcagacacaaccccgtgttcggcgtgatgagctag

SEQ ID NO: 9390 - DNA, 1071 bp, Artificial Sequence
  Description of Artificial Sequence: Synthetic coding sequence
atgctggagatccagaaccacagcctgagcagcctgccctggcccatcagacacggcatcgtggaggactgggacctgatggagagattcatggagcaggtgatcttcaagtacctgagagccgagcccgaggaccactacttcctgctgaccgagccccccctgaacacccccgagaacagagagtacaccgccgagatcatgttcgagagcttcaacgtgcccggcctgtacatcgccgtgcaggccgtgctggccctggccgccagctggaccagcagacaggtgggcgagagaaccctgaccggcaccgtgatcgacagcggcgacggcgtgacccacgtgatccccgtggccgagggctacgtgatcggcagctgcatcaagcacatccccatcgccggcagagacatcacctacttcatccagcagctgctgagagacagagaggtgggcatcccccccgagcagagcctggagaccgccaaggccgtgaaggagagatacagctacgtgtgccccgacctggtgaaggagttcaacaagtacgacaccgacggcagcaagtggatcaagcagtacaccggcatcaacgccatcagcaagaaggagttcagcatcgacgtgggctacgagagattcctgggccccgagatcttcttccaccccgagttcgccaaccccgacttcacccagcccatcagcgaggtggtggacgaggtgatccagaactgccccatcgacgtgagaagacccctgtacaagaacatcgtgctgagcggcggcagcaccatgttcagagacttcggcagaagactgcagagagacctgaagagaaccgtggacgccagactgaagctgagcgaggagctgagcggcggcagactgaagcccaagcccatcgacgtgcaggtgatcacccaccacatgcagagatacgccgtgtggttcggcggcagcatgctggccagcacccccgagttctaccaggtgtgccacaccaagaaggactacgaggagatcggccccagcatctgcagacacaaccccgtgttcggcgtgatgagctag

SEQ ID NO: 9391 - DNA, 870 bp, Artificial Sequence
  Description of Artificial Sequence: Synthetic coding sequence
atgttcgagagcttcaacgtgcccggcctgtacatcgccgtgcaggccgtgctggccctggccgccagctggaccagcagacaggtgggcgagagaaccctgaccggcaccgtgatcgacagcggcgacggcgtgacccacgtgatccccgtggccgagggctacgtgatcggcagctgcatcaagcacatccccatcgccggcagagacatcacctacttcatccagcagctgctgagagacagagaggtgggcatcccccccgagcagagcctggagaccgccaaggccgtgaaggagagatacagctacgtgtgccccgacctggtgaaggagttcaacaagtacgacaccgacggcagcaagtggatcaagcagtacaccggcatcaacgccatcagcaagaaggagttcagcatcgacgtgggctacgagagattcctgggccccgagatcttcttccaccccgagttcgccaaccccgacttcacccagcccatcagcgaggtggtggacgaggtgatccagaactgccccatcgacgtgagaagacccctgtacaagaacatcgtgctgagcggcggcagcaccatgttcagagacttcggcagaagactgcagagagacctgaagagaaccgtggacgccagactgaagctgagcgaggagctgagcggcggcagactgaagcccaagcccatcgacgtgcaggtgatcacccaccacatgcagagatacgccgtgtggttcggcggcagcatgctggccagcacccccgagttctaccaggtgtgccacaccaagaaggactacgaggagatcggccccagcatctgcagacacaaccccgtgttcggcgtgatgagctag

SEQ ID NO: 9392 - DNA, 1749 bp, Artificial Sequence
  Description of Artificial Sequence: Synthetic coding sequence
atcgacatcgagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgagaatggccgtgcagcacatgaagaccctgagaggcgccaccaacccctacaccgaggccaactacaagcccaccttcctgagcgacgacgagctgaagcacctgatcctgagagccgccgacggcttcctgttcgtggtgggctgcgacagaggcaagatcctgttcgtgagcgagagcgtgttcaagatcctgaactacagccagaacgacctgatcggccagagcctgttcgactacctgcaccccaaggacatcgccaaggtgaaggagcagctgagcagcagcgacaccgcccccagagagagactgatcgacgccaagaccggcctgcccgtgaagaccgacatcacccccggccccagcagactgtgcagcggcgccagaagaagcttcttctgcagaatgaagtgcaacagacccagcgtgaaggtggaggacaaggacttccccagcacctgcagcaagaagaaggccgacagaaagagcttctgcaccatccacagcaccggctacctgaagagctggccccccaccaagatgggcctggacgaggacaacgagcccgacaacgagggctgcaacctgagctgcctggtggccatcggcagactgcacagccacgtggtgccccagcccgtgaacggcgagatcagagtgaagagcatggagtacgtgagcagacacgccatcgacggcaagttcgtgttcgtggaccagagagccaccgccatcctggcctacctgccccaggagctgctgggcaccagctgctacgagtacttccaccaggacgacatcggccacctggccgagtgccacagacaggtgctgcagaccagagagaagatcaccaccaactgctacaagttcaagatcaaggacggcagcttcatcaccctgagaagcagatggttcagcttcatgaacccctggaccaaggaggtggagtacatcgtgagcaccaacaccgtggtgctggccaacgtgctggagggcggcgaccccaccttcccccagctgaccgccagcccccacagcatggacagcatgctgcccagcggcgagggcggccccaagagaacccaccccaccgtgcccggcatccccggcggcaccagagccggcgccggcaagatcggcagaatgatcgccgaggagatcatggagatccacagaatcagaggcagcagccccagcagctgcggcagcagccccctgaacatcaccagcacccccccccccgacgccagcagccccggcggcaagaagatcctgaacggcggcacccccgacatccccagcagcggcctgctgagcggccaggcccaggagaaccccggctacccctacagcgacagcagcagcatcctgggcgagaacccccacatcggcatcgacatgatcgacaacgaccagggcagcagcagccccagcaacgacgaggccgccatggccgtgatcatgagcctgctggaggccgacgccggcctgggcggccccgtggacttcagcgacctgccctggcccctgtag

SEQ ID NO: 9393 - DNA, 1527 bp, Artificial Sequence
  Description of Artificial Sequence: Synthetic coding sequence
atggccgaccagagaatggacatcagcagcaccatcagcgacttcatgagccccggccccaccgacctgctgagcagcagcctgggcaccagcggcgtggactgcaacagaaagagaaagggcagcagcaccgactaccaggagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgagaatggccgtgcagcacatgaagaccctgagaggcgccaccaacccctacaccgaggccaactacaagcccaccttcctgagcgacgacgagctgaagcacctgatcctgagagccgccgacggcttcctgttcgtggtgggctgcgacagaggcaagatcctgttcgtgagcgagagcgtgttcaagatcctgaactacagccagaacgacctgatcggccagagcctgttcgactacctgcaccccaaggacatcgccaaggtgaaggagcagctgagcagcagcgacaccgcccccagagagagactgatcgacgccaagaccggcctgcccgtgaagaccgacatcacccccggccccagcagactgtgcagcggcgccagaagaagcttcttctgcagaatgaagtgcaacagacccagcgtgaaggtggaggacaaggacttccccagcacctgcagcaagaagaaggtgctgcagaccagagagaagatcaccaccaactgctacaagttcaagatcaaggacggcagcttcatcaccctgagaagcagatggttcagcttcatgaacccctggaccaaggaggtggagtacatcgtgagcaccaacaccgtggtgctggccaacgtgctggagggcggcgaccccaccttcccccagctgaccgccagcccccacagcatggacagcatgctgcccagcggcgagggcggccccaagagaacccaccccaccgtgcccggcatccccggcggcaccagagccggcgccggcaagatcggcagaatgatcgccgaggagatcatggagatccacagaatcagaggcagcagccccagcagctgcggcagcagccccctgaacatcaccagcacccccccccccgacgccagcagccccggcggcaagaagatcctgaacggcggcacccccgacatccccagcagcggcctgctgagcggccaggcccaggagaaccccggctacccctacagcgacagcagcagcatcctgggcgagaacccccacatcggcatcgacatgatcgacaacgaccagggcagcagcagccccagcaacgacgaggccgccatggccgtgatcatgagcctgctggaggccgacgccggcctgggcggccccgtggacttcagcgacctgccctggcccctgtag

SEQ ID NO: 9394 - DNA, 1878 bp, Artificial Sequence
  Description of Artificial Sequence: Synthetic coding sequence
atggccgaccagagaatggacatcagcagcaccatcagcgacttcatgagccccggccccaccgacctgctgagcagcagcctgggcaccagcggcgtggactgcaacagaaagagaaagggcagcagcaccgactaccaggagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgagaatggccgtgcagcacatgaagaccctgagaggcgccaccaacccctacaccgaggccaactacaagcccaccttcctgagcgacgacgagctgaagcacctgatcctgagagccgccgacggcttcctgttcgtggtgggctgcgacagaggcaagatcctgttcgtgagcgagagcgtgttcaagatcctgaactacagccagaacgacctgatcggccagagcctgttcgactacctgcaccccaaggacatcgccaaggtgaaggagcagctgagcagcagcgacaccgcccccagagagagactgatcgacgccaagaccggcctgcccgtgaagaccgacatcacccccggccccagcagactgtgcagcggcgccagaagaagcttcttctgcagaatgaagtgcaacagacccagcgtgaaggtggaggacaaggacttccccagcacctgcagcaagaagaaggacagaaagagcttctgcaccatccacagcaccggctacctgaagagctggccccccaccaagatgggcctggacgaggacaacgagcccgacaacgagggctgcaacctgagctgcctggtggccatcggcagactgcacagccacgtggtgccccagcccgtgaacggcgagatcagagtgaagagcatggagtacgtgagcagacacgccatcgacggcaagttcgtgttcgtggaccagagagccaccgccatcctggcctacctgccccaggagctgctgggcaccagctgctacgagtacttccaccaggacgacatcggccacctggccgagtgccacagacaggtgctgcagaccagagagaagatcaccaccaactgctacaagttcaagatcaaggacggcagcttcatcaccctgagaagcagatggttcagcttcatgaacccctggaccaaggaggtggagtacatcgtgagcaccaacaccgtggtgctggccaacgtgctggagggcggcgaccccaccttcccccagctgaccgccagcccccacagcatggacagcatgctgcccagcggcgagggcggccccaagagaacccaccccaccgtgcccggcatccccggcggcaccagagccggcgccggcaagatcggcagaatgatcgccgaggagatcatggagatccacagaatcagaggcagcagccccagcagctgcggcagcagccccctgaacatcaccagcacccccccccccgacgccagcagccccggcggcaagaagatcctgaacggcggcacccccgacatccccagcagcggcctgctgagcggccaggcccaggagaaccccggctacccctacagcgacagcagcagcatcctgggcgagaacccccacatcggcatcgacatgatcgacaacgaccagggcagcagcagccccagcaacgacgaggccgccatggccgtgatcatgagcctgctggaggccgacgccggcctgggcggccccgtggacttcagcgacctgccctggcccctgtag

SEQ ID NO: 9395 - DNA, 1581 bp, Artificial Sequence
  Description of Artificial Sequence: Synthetic coding sequence
atggccgaccagagaatggacatcagcagcaccatcagcgacttcatgagccccggccccaccgacctgctgagcagcagcctgggcaccagcggcgtggactgcaacagaaagagaaagggcagcagcaccgactaccaggagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgagaatggccgtgcagcacatgaagaccctgagaggcgccaccaacccctacaccgaggccaactacaagcccaccttcctgagcgacgacgagctgaagcacctgatcctgagagccgccgacggcttcctgttcgtggtgggctgcgacagaggcaagatcctgttcgtgagcgagagcgtgttcaagatcctgaactacagccagaacgacctgatcggccagagcctgttcgactacctgcaccccaaggacatcgccaaggtgaaggagcagctgagcagcagcgacaccgcccccagagagagactgatcgacgccaagaccggcctgcccgtgaagaccgacatcacccccggccccagcagactgtgcagcggcgccagaagaagcttcttctgcagaatgaagtgcaacagacccagcgtgaaggtggaggacaaggacttccccagcacctgcagcaagaagaaggccgacagaaagagcttctgcaccatccacagcaccggctacctgaagagctggccccccaccaagatgggcctggacgaggacaacgagcccgacaacgagggctgcaacctgagctgcctggtggccatcggcagactgcacagccacgtggtgccccagcccgtgaacggcgagatcagagtgaagagcatggagtacgtgagcagacacgccatcgacggcaagttcgtgttcgtggaccagagagccaccgccatcctggcctacctgccccaggagctgctgggcaccagctgctacgagtacttccaccaggacgacatcggccacctggccgagtgccacagacaggtgctgcagaccagagagaagatcaccaccaactgctacaagttcaagatcaaggacggcagcttcatcaccctgagaagcagatggttcagcttcatgaacccctggaccaaggaggtggagtacatcgtgagcaccaacaccgtggtgctgagcagagtggacaccggccacctgggccaggtggagtggtgcaccgtgctgagcagacccgacagcagattcctgatcgccggcatgttcaccgagcccaccagctggaaggccggcacccagcccagccacagcagccagcacccccccaccgcctggaccgcctgctgccccctggagaaggtggcccagagaggccccacccccctgttccagggcttccagggcgagcccggcctgggccaggagaagtag

SEQ ID NO: 9396 - DNA, 1878 bp, Artificial Sequence; identical to SEQ ID NO: 9394
  Description of Artificial Sequence: Synthetic coding sequence

SEQ ID NO: 9397 - DNA, 1752 bp, Artificial Sequence
  Description of Artificial Sequence: Synthetic coding sequence
atgatcaacatcgagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgagaatggccgtgcagcacatgaagaccctgagaggcgccaccaacccctacaccgaggccaactacaagcccaccttcctgagcgacgacgagctgaagcacctgatcctgagagccgccgacggcttcctgttcgtggtgggctgcgacagaggcaagatcctgttcgtgagcgagagcgtgttcaagatcctgaactacagccagaacgacctgatcggccagagcctgttcgactacctgcaccccaaggacatcgccaaggtgaaggagcagctgagcagcagcgacaccgcccccagagagagactgatcgacgccaagaccggcctgcccgtgaagaccgacatcacccccggccccagcagactgtgcagcggcgccagaagaagcttcttctgcagaatgaagtgcaacagacccagcgtgaaggtggaggacaaggacttccccagcacctgcagcaagaagaaggccgacagaaagagcttctgcaccatccacagcaccggctacctgaagagctggccccccaccaagatgggcctggacgaggacaacgagcccgacaacgagggctgcaacctgagctgcctggtggccatcggcagactgcacagccacgtggtgccccagcccgtgaacggcgagatcagagtgaagagcatggagtacgtgagcagacacgccatcgacggcaagttcgtgttcgtggaccagagagccaccgccatcctggcctacctgccccaggagctgctgggcaccagctgctacgagtacttccaccaggacgacatcggccacctggccgagtgccacagacaggtgctgcagaccagagagaagatcaccaccaactgctacaagttcaagatcaaggacggcagcttcatcaccctgagaagcagatggttcagcttcatgaacccctggaccaaggaggtggagtacatcgtgagcaccaacaccgtggtgctggccaacgtgctggagggcggcgaccccaccttcccccagctgaccgccagcccccacagcatggacagcatgctgcccagcggcgagggcggccccaagagaacccaccccaccgtgcccggcatccccggcggcaccagagccggcgccggcaagatcggcagaatgatcgccgaggagatcatggagatccacagaatcagaggcagcagccccagcagctgcggcagcagccccctgaacatcaccagcacccccccccccgacgccagcagccccggcggcaagaagatcctgaacggcggcacccccgacatccccagcagcggcctgctgagcggccaggcccaggagaaccccggctacccctacagcgacagcagcagcatcctgggcgagaacccccacatcggcatcgacatgatcgacaacgaccagggcagcagcagccccagcaacgacgaggccgccatggccgtgatcatgagcctgctggaggccgacgccggcctgggcggccccgtggacttcagcgacctgccctggcccctgtag

SEQ ID NO: 9398 - DNA, 1881 bp, Artificial Sequence
  Description of Artificial Sequence: Synthetic coding sequence
atggccgaccagagaatggacatcagcagcaccatcagcgacttcatgagccccggccccaccgacctgctgagcagcagcctgggcaccagcggcgtggactgcaacagaaagagaaagggcagcagcaccgactaccaggagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgagaatggccgtgcagcacatgaagaccctgagaggcgccaccaacccctacaccgaggccaactacaagcccaccttcctgagcgacgacgagctgaagcacctgatcctgagagccgccgacggcttcctgttcgtggtgggctgcgacagaggcaagatcctgttcgtgagcgagagcgtgttcaagatcctgaactacagccagaacgacctgatcggccagagcctgttcgactacctgcaccccaaggacatcgccaaggtgaaggagcagctgagcagcagcgacaccgcccccagagagagactgatcgacgccaagaccggcctgcccgtgaagaccgacatcacccccggccccagcagactgtgcagcggcgccagaagaagcttcttctgcagaatgaagtgcaacagacccagcgtgaaggtggaggacaaggacttccccagcacctgcagcaagaagaaggccgacagaaagagcttctgcaccatccacagcaccggctacctgaagagctggccccccaccaagatgggcctggacgaggacaacgagcccgacaacgagggctgcaacctgagctgcctggtggccatcggcagactgcacagccacgtggtgccccagcccgtgaacggcgagatcagagtgaagagcatggagtacgtgagcagacacgccatcgacggcaagttcgtgttcgtggaccagagagccaccgccatcctggcctacctgccccaggagctgctgggcaccagctgctacgagtacttccaccaggacgacatcggccacctggccgagtgccacagacaggtgctgcagaccagagagaagatcaccaccaactgctacaagttcaagatcaaggacggcagcttcatcaccctgagaagcagatggttcagcttcatgaacccctggaccaaggaggtggagtacatcgtgagcaccaacaccgtggtgctggccaacgtgctggagggcggcgaccccaccttcccccagctgaccgccagcccccacagcatggacagcatgctgcccagcggcgagggcggccccaagagaacccaccccaccgtgcccggcatccccggcggcaccagagccggcgccggcaagatcggcagaatgatcgccgaggagatcatggagatccacagaatcagaggcagcagccccagcagctgcggcagcagccccctgaacatcaccagcacccccccccccgacgccagcagccccggcggcaagaagatcctgaacggcggcacccccgacatccccagcagcggcctgctgagcggccaggcccaggagaaccccggctacccctacagcgacagcagcagcatcctgggcgagaacccccacatcggcatcgacatgatcgacaacgaccagggcagcagcagccccagcaacgacgaggccgccatggccgtgatcatgagcctgctggaggccgacgccggcctgggcggccccgtggacttcagcgacctgccctggcccctgtag

SEQ ID NO: 9399 - DNA, 1749 bp, Artificial Sequence
  Description of Artificial Sequence: Synthetic coding sequence
atgatcaacatcgagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgagaatggccgtgcagcacatgaagaccctgagaggcgccaccaacccctacaccgaggccaactacaagcccaccttcctgagcgacgacgagctgaagcacctgatcctgagagccgccgacggcttcctgttcgtggtgggctgcgacagaggcaagatcctgttcgtgagcgagagcgtgttcaagatcctgaactacagccagaacgacctgatcggccagagcctgttcgactacctgcaccccaaggacatcgccaaggtgaaggagcagctgagcagcagcgacaccgcccccagagagagactgatcgacgccaagaccggcctgcccgtgaagaccgacatcacccccggccccagcagactgtgcagcggcgccagaagaagcttcttctgcagaatgaagtgcaacagacccagcgtgaaggtggaggacaaggacttccccagcacctgcagcaagaagaaggacagaaagagcttctgcaccatccacagcaccggctacctgaagagctggccccccaccaagatgggcctggacgaggacaacgagcccgacaacgagggctgcaacctgagctgcctggtggccatcggcagactgcacagccacgtggtgccccagcccgtgaacggcgagatcagagtgaagagcatggagtacgtgagcagacacgccatcgacggcaagttcgtgttcgtggaccagagagccaccgccatcctggcctacctgccccaggagctgctgggcaccagctgctacgagtacttccaccaggacgacatcggccacctggccgagtgccacagacaggtgctgcagaccagagagaagatcaccaccaactgctacaagttcaagatcaaggacggcagcttcatcaccctgagaagcagatggttcagcttcatgaacccctggaccaaggaggtggagtacatcgtgagcaccaacaccgtggtgctggccaacgtgctggagggcggcgaccccaccttcccccagctgaccgccagcccccacagcatggacagcatgctgcccagcggcgagggcggccccaagagaacccaccccaccgtgcccggcatccccggcggcaccagagccggcgccggcaagatcggcagaatgatcgccgaggagatcatggagatccacagaatcagaggcagcagccccagcagctgcggcagcagccccctgaacatcaccagcacccccccccccgacgccagcagccccggcggcaagaagatcctgaacggcggcacccccgacatccccagcagcggcctgctgagcggccaggcccaggagaaccccggctacccctacagcgacagcagcagcatcctgggcgagaacccccacatcggcatcgacatgatcgacaacgaccagggcagcagcagccccagcaacgacgaggccgccatggccgtgatcatgagcctgctggaggccgacgccggcctgggcggccccgtggacttcagcgacctgccctggcccctgtag

SEQ ID NO: 9400 - DNA, 219 bp, Artificial Sequence
  Description of Artificial Sequence: Synthetic coding sequence
atgatcaacatcgagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgtag

SEQ ID NO: 9401 - DNA, 231 bp, Artificial Sequence
  Description of Artificial Sequence: Synthetic coding sequence
atggccgaccagagaatggacatcagcagcaccatcagcgacttcatgagccccggccccaccgacctgctgagcagcagcctgggcaccagcggcgtggactgcaacagaaagagaaagggcagcagcaccgactaccaggagagcatggacaccgacaaggacgacccccacggcagactggagtacaccgagcaccagggcagaatcaagaacgccagagaggcctag

SEQ ID NO: 9402 - DNA, 72 bp, Artificial Sequence
  Description of Artificial Sequence: Synthetic coding sequence
atggccgaccagagaatggacatcagcagcaccatcagcgacttcatgagccccggccccaccgacctgtag

SEQ ID NO: 9403 - DNA, 408 bp, Artificial Sequence
  Description of Artificial Sequence: Synthetic coding sequence
atggccgaccagagaatggacatcagcagcaccatcagcgacttcatgagccccggccccaccgacctgctgagcagcagcctgggcaccagcggcgtggactgcaacagaaagagaaagggcagcagcaccgactaccaggagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgagaatggccgtgcagcacatgaagaccctgagaggcgccaccaacccctacaccgaggcctag

SEQ ID NO: 9404 - DNA, 141 bp, Artificial Sequence
  Description of Artificial Sequence: Synthetic coding sequence
atgatcaacatcgagagcatggacaccgacaaggacgacccccacggcagactggagtacaccgagcaccagggcagaatcaagaacgccagagaggcccacagccagatcgagaagagaagaagagacaagatgaactag

SEQ ID NO: 9405 - DNA, 426 bp, Artificial Sequence
  Description of Artificial Sequence: Synthetic coding sequence
atgatcaacatcgagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctgcaacgccatgagcagaaagctggacaagctgaccgtgctgagaatggccgtgcagcacatgaagaccctgagaggcgccaccaacccctacaccgaggccaactacaagcccaccttcctgagcgacgacgagctgaagcacctgatcctgagagccgccgacggcttcctgttcgtggtgggctgcgacagaggcaagatcctgttcgtgagcgagagcgtgttcaagatcctgaactacagccagtag

SEQ ID NO: 9406 - DNA, 306 bp, Artificial Sequence
  Description of Artificial Sequence: Synthetic coding sequence
atggccgaccagagaatggacatcagcagcaccatcagcgacttcatgagccccggccccaccgacctgctgagcagcagcctgggcaccagcggcgtggactgcaacagaaagagaaagggcagcagcaccgactaccaggagagcatggacaccgacaaggacgacccccacggcagactggagtacaccgagcaccagggcagaatcaagaacgccagagaggcccacagccagatcgagaagagaagaagagacaagatgaacagcttcatcgacgagctggccagcctggtgcccacctag

SEQ ID NO: 9407 - DNA, 180 bp, Artificial Sequence
  Description of Artificial Sequence: Synthetic coding sequence
atggccgaccagagaatggacatcagcagcaccatcagcgacttcatgagccccggccccaccgacctgctgagcagcagcctgggcaccagcggcgtggactgcaacagaaagagaaagggcagcagcaccgactaccaggagagcatggacaccgacaaggacgacccccacggctag

SEQ ID NO: 9408 - DNA, 1683 bp, Artificial Sequence
  Description of Artificial Sequence: Synthetic coding sequence
atggagcccctgcagcagcagcagcagcagcagcagcagcagcagaagcagccccacctggcccccctgcagatggacgccagagagaagcagggccagcagatgagagaggcccagttcctgtacgcccagaagctggtgacccagcccaccctgctgagcgccaccgccggcagacccagcggcagcacccccctgggccccctggccagagtgccccccaccgccgccgtggcccaggtgttcgagagaggcaacatgaacagcgagcccgaggaggaggacggcggcctggaggacgaggacggcgacgacgaggtggccgaggtggccgagaaggagacccaggccgccagcaagtacttccacgtgcagaaggtggccagacaggaccccagagtggcccccatgagcaacctgctgcccgcccccggcctgcccccccacggccagcaggccaaggaggaccacaccaaggacgccagcaaggccagccccagcgtgagcaccgccggccagcccaactggaacctggacgagcagctgaagcagaacggcggcctggcctggagcgacgacgccgacggcggcagaggcagagagatcagcagagacttcgccaagctgtacgagctggacggcgaccccgagagaaaggagttcctggacgacctgttcgtgttcatgcagaagagaggcacccccatcaacagaatccccatcatggccaagcagatcctggacctgtacatgctgtacaagctggtgaccgagaagggcggcctggtggagatcatcaacaagaagatctggagagagatcaccaagggcctgaacctgcccaccagcatcaccagcgccgccttcaccctgagaacccagtacatgaagtacctgtacgcctacgagtgcgagaagaaggccctgagcagccccgccgagctgcaggccgccatcgacggcaacagaagagagggcagaagacccagctacagcagcagcctgttcggctacagccccgccgccgccaccgccgccgccgccgccggcgcccccgccctgctgagcccccccaagatcagattccccatcctgggcctgggcagcagcagcggcaccaacaccagcagccccagaatcagccccgccaccaccctgagaaagggcgacggcgcccccgtgaccaccgtgcccgtgcccaacagactggccgtgcccgtgaccctggccagccagcaggccggcaccagaaccgccgccctggagcagctgagagagagactggagagcggcgagcccgccgagaagaaggccagcagactgagcgaggaggagcagagactggtgcagcaggccttccagagaaacttcttcagcatggccagacagctgcccatgaagatcagaatcaacggcagagaggacagagccgaggccagcgccgccgccctgaacctgaccaccagcagcatcggcagcatcaacatgagcgtggacatcgacggcaccacctacgccggcgtgctgttcgcccagaagcccgtggtgcacctgatcaccggcagcgccccccagagcctgggcagcagcgccagcagcagcagcagcagccactgcagccccagccccaccagcagcagaggcacccccagcgccgagcccagcaccagctggagcctgtag

SEQ ID NO: 9409 - DNA, 1335 bp, Artificial Sequence
  Description of Artificial Sequence: Synthetic coding sequence
atggagcccctgcagcagcagcagcagcagcagcagcagcagcagaagcagccccacctggcccccctgcagatggacgccagagagaagcagggccagcagatgagagaggcccagttcctgtacgcccagaagctggtgacccagcccaccctgctgagcgccaccgccggcagacccagcggcagcacccccctgggccccctggccagagtgccccccaccgccgccgtggcccaggtgttcgagagaggcaacatgaacagcgagcccgaggaggaggacggcggcctggaggacgaggacggcgacgacgaggtggccgaggtggccgagaaggagacccaggccgccagcaagtacttccacgtgcagaaggtggccagacaggaccccagagtggcccccatgagcaacctgctgcccgcccccggcctgcccccccacggccagcaggccaaggaggaccacaccaaggacgccagcaaggccagccccagcgtgagcaccgccggccagcccaactggaacctggacgagcagctgaagcagaacggcggcctggcctggagcgacgacgccgacggcggcagaggcagagagatcagcagagacttcgccaagctgtacgagctggacggcgaccccgagagaaaggagttcctggacgacctgttcgtgttcatgcagaagagaggcacccccatcaacagaatccccatcatggccaagcagatcctggacctgtacatgctgtacaagctggtgaccgagaagggcggcctggtggagatcatcaacaagaagatctggagagagatcaccaagggcctgaacctgcccaccagcatcaccagcgccgccttcaccctgagaacccagtacatgaagtacctgtacgcctacgagtgcgagaagaaggccctgagcagccccgccgagctgcaggccgccatcgacggcaacagaagagagggcagaagacccagctacagcagcagcctgttcggctacagccccgccgccgccaccgccgccgccgccgccggcgcccccgccctgctgagcccccccaagatcagattccccatcctgggcctgggcagcagcagcggcaccaacaccagcagccccagaatcagccccgccaccaccctgagaaagggcgacggcgcccccgtgaccaccgtgcccgtgcccaacagactggccgtgcccgtgaccctggccagccagcaggccggcaccagaaccgccgccctggagcagctgagagagagactggagagcggcgagcccgccgagaagaaggccagcggcacctggtgccagtag

SEQ ID NO: 9410 - DNA, 1413 bp, Artificial Sequence
  Description of Artificial Sequence: Synthetic coding sequence
atggagcccctgcagcagcagcagcagcagcagcagcagcagcagaagcagccccacctggcccccctgcagatggacgccagagagaagcagggccagcagatgagagaggcccagttcctgtacgcccagaagctggtgacccagcccaccctgctgagcgccaccgccggcagacccagcggcagcacccccctgggccccctggccagagtgccccccaccgccgccgtggcccaggtgttcgagagaggcaacatgaacagcgagcccgaggaggaggacggcggcctggaggacgaggacggcgacgacgaggtggccgaggtggccgagaaggagacccaggccgccagcaagtacttccacgtgcagaaggtggccagacaggaccccagagtggcccccatgagcaacctgctgcccgcccccggcctgcccccccacggccagcaggccaaggaggaccacaccaaggacgccagcaaggccagccccagcgtgagcaccgccggccagcccaactggaacctggacgagcagctgaagcagaacggcggcctggcctggagcgacgacgccgacggcggcagaggcagagagatcagcagagacttcgccaagctgtacgagctggacggcgaccccgagagaaaggagttcctggacgacctgttcgtgttcatgcagaagagaggcacccccatcaacagaatccccatcatggccaagcagatcctggacctgtacatgctgtacaagctggtgaccgagaagggcggcctggtggagatcatcaacaagaagatctggagagagatcaccaagggcctgaacctgcccaccagcatcaccagcgccgccttcaccctgagaacccagtacatgaagtacctgtacgcctacgagtgcgagaagaaggccctgagcagccccgccgagctgcaggccgccatcgacggcaacagaagagagggcagaagacccagctacagcagcagcctgttcggctacagccccgccgccgccaccgccgccgccgccgccggcgcccccgccctgctgagcccccccaagatcagattccccatcctgggcctgggcagcagcagcggcaccaacaccagcagccccagaatcagccccgccaccaccctgagaaagggcgacggcgcccccgtgaccaccgtgcccgtgcccaacagactggccgtgcccgtgaccctggccagccagcaggccggcaccagaaccgccgccctggagcagctgagagagagactggagagcggcgagcccgccgagaagaaggccagcagactgagcgaggaggagcagagactggtgcagcaggccttccagagaaacttcttcagcatggccagacagctgagcatcctgtacgtgttctag

SEQ ID NO: 9411 - DNA, 7935 bp, Artificial Sequence
  Description of Artificial Sequence: Synthetic coding sequence
atgggcgagcacggcctggagctggccagcatgatccccgccctgagagagctgggcagcgccacccccgaggagtacaacaccgtggtgcagaagcccagacagatcctgtgccagttcatcgacagaatcctgaccgacgtgaacgtggtggccgtggagctggtgaagaagaccgacagccagcccaccagcgtgatgctgctggacttcatccagcacatcatgaagagcagccccctgatgttcgtgaacgtgagcggcagccacgaggccaagggcagctgcatcgagttcagcaactggatcatcaccagactgctgagaatcgccgccacccccagctgccacctgctgcacaagaagatctgcgaggtgatctgcagcctgctgttcctgttcaagagcaagagccccgccatcttcggcgtgctgaccaaggagctgctgcagctgttcgaggacctggtgtacctgcacagaagaaacgtgatgggccacgccgtggagtggcccgtggtgatgagcagattcctgagccagctggacgagcacatgggctacctgcagagcgcccccctgcagctgatgagcatgcagaacctggagttcatcgaggtgaccctgctgatggtgctgaccagaatcatcgccatcgtgttcttcagaagacaggagctgctgctgtggcagatcggctgcgtgctgctggagtacggcagccccaagatcaagagcctggccatcagcttcctgaccgagctgttccagctgggcggcctgcccgcccagcccgccagcaccttcttcagcagcttcctggagctgctgaagcacctggtggagatggacaccgaccagctgaagctgtacgaggagcccctgagcaagctgatcaagaccctgttccccttcgaggccgaggcctacagaaacatcgagcccgtgtacctgaacatgctgctggagaagctgtgcgtgatgttcgaggacggcgtgctgatgagactgaagagcgacctgctgaaggccgccctgtgccacctgctgcagtacttcctgaagttcgtgcccgccggctacgagagcgccctgcaggtgagaaaggtgtacgtgagaaacatctgcaaggccctgctggacgtgctgggcatcgaggtggacgccgagtacctgctgggccccctgtacgccgccctgaagatggagagcatggagatcatcgaggagatccagtgccagacccagcaggagaacctgagcagcaacagcgacggcatcagccccaagagaagaagactgagcagcagcctgaaccccagcaagagagcccccaagcagaccgaggagatcaagcacgtggacatgaaccagaagagcatcctgtggagcgccctgaagcagaaggccgagagcctgcagatcagcctggagtacagcggcctgaagaaccccgtgatcgagatgctggagggcatcgccgtggtgctgcagctgaccgccctgtgcaccgtgcactgcagccaccagaacatgaactgcagaaccttcaaggactgccagcacaagagcaagaagaagcccagcgtggtgatcacctggatgagcctggacttctacaccaaggtgctgaagagctgcagaagcctgctggagagcgtgcagaagctggacctggaggccaccatcgacaaggtggtgaagatctacgacgccctgatctacatgcaggtgaacagcagcttcgaggaccacatcctggaggacctgtgcggcatgctgagcctgccctggatctacagccacagcgacgacggctgcctgaagctgaccaccttcgccgccaacctgctgaccctgagctgcagaatcagcgacagctacagcccccaggcccagagcagatgcgtgttcctgctgaccctgttccccagaagaatcttcctggagtggagaaccgccgtgtacaactgggccctgcagagcagccacgaggtgatcagagccagctgcgtgagcggcttcttcatcctgctgcagcagcagaacagctgcaacagagtgcccaagatcctgatcgacaaggtgaaggacgacagcgacatcgtgaagaaggagttcgccagcatcctgggccagctggtgtgcaccctgcacggcatgttctacctgaccagcagcctgaccgagcccttcagcgagcacggccacgtggacctgttctgcagaaacctgaaggccaccagccagcacgagtgcagcagcagccagctgaaggccagcgtgtgcaagcccttcctgttcctgctgaagaagaagatccccagccccgtgaagctggccttcatcgacaacctgcaccacctgtgcaagcacctggacttcagagaggacgagaccgacgtgaaggccgtgctgggcaccctgctgaacctgatggaggaccccgacaaggacgtgagagtggccttcagcggcaacatcaagcacatcctggagagcctggacagcgaggacggcttcatcaaggagctgttcgtgctgagaatgaaggaggcctacacccacgcccagatcagcagaaacaacgagctgaaggacaccctgatcctgaccaccggcgacatcggcagagccgccaagggcgacctggtgcccttcgccctgctgcacctgctgcactgcctgctgagcaagagcgccagcgtgagcggcgccgcctacaccgagatcagagccctggtggccgccaagagcgtgaagctgcagagcttcttcagccagtacaagaagcccatctgccagttcctggtggagagcctgcacagcagccagatgaccgccctgcccaacaccccctgccagaacgccgacgtgagaaagcaggacgtggcccaccagagagagatggccctgaacaccctgagcgagatcgccaacgtgttcgacttccccgacctgaacagattcctgaccagaaccctgcaggtgctgctgcccgacctggccgccaaggccagccccgccgccagcgccctgatcagaaccctgggcaagcagctgaacgtgaacagaagagagatcctgatcaacaacttcaagtacatcttcagccacctggtgtgcagctgcagcaaggacgagctggagagagccctgcactacctgaagaacgagaccgagatcgagctgggcagcctgctgagacaggacttccagggcctgcacaacgagctgctgctgagaatcggcgagcactaccagcaggtgttcaacggcctgagcatcctggccagcttcgccagcagcgacgacccctaccagggccccagagacatcatcagccccgagctgatggccgactacctgcagcccaagctgctgggcatcctggccttcttcaacatgcagctgctgagcagcagcgtgggcatcgaggacaagaagatggccctgaacagcctgatgagcctgatgaagctgatgggccccaagcacgtgagcagcgtgagagtgaagatgatgaccaccctgagaaccggcctgagattcaaggacgacttccccgagctgtgctgcagagcctgggactgcttcgtgagatgcctggaccacgcctgcctgggcagcctgctgagccacgtgatcgtggccctgctgcccctgatccacatccagcccaaggagaccgccgccatcttccactacctgatcatcgagaacagagacgccgtgcaggacttcctgcacgagatctacttcctgcccgaccaccccgagctgaagaagatcaaggccgtgctgcaggagtacagaaaggagaccagcgagagcaccgacctgcagaccaccctgcagctgagcatgaaggccatccagcacgagaacgtggacgtgagaatccacgccctgaccagcctgaaggagaccctgtacaagaaccaggagaagctgatcaagtacgccaccgacagcgagaccgtggagcccatcatcagccagctggtgaccgtgctgctgaagggctgccaggacgccaacagccaggccagactgctgtgcggcgagtgcctgggcgagctgggcgccatcgaccccggcagactggacttcagcaccaccgagacccagggcaaggacttcaccttcgtgaccggcgtggaggacagcagcttcgcctacggcctgctgatggagctgaccagagcctacctggcctacgccgacaacagcagagcccaggacagcgccgcctacgccatccaggagctgctgagcatctacgactgcagagagatggagaccaacggccccggccaccagctgtggagaagattccccgagcacgtgagagagatcctggagccccacctgaacaccagatacaagagcagccagaagagcaccgactggagcggcgtgaagaagcccatctacctgagcaagctgggcagcaacttcgccgagtggagcgccagctgggccggctacctgatcaccaaggtgagacacgacctggccagcaagatcttcacctgctgcagcatcatgatgaagcacgacttcaaggtgaccatctacctgctgccccacatcctggtgtacgtgctgctgggctgcaaccaggaggaccagcaggaggtgtacgccgagatcatggccgtgctgaagcacgacgaccagcacaccatcaacacccaggacatcgccagcgacctgtgccagctgagcacccagaccgtgttcagcatgctggaccacctgacccagtgggccagacacaagttccaggccctgaaggccgagaagtgcccccacagcaagagcaacagaaacaaggtggacagcatggtgagcaccgtggactacgaggactaccagagcgtgaccagattcctggacctgatcccccaggacaccctggccgtggccagcttcagaagcaaggcctacaccagagccgtgatgcacttcgagagcttcatcaccgagaagaagcagaacatccaggagcacctgggcttcctgcagaagctgtacgccgccatgcacgagcccgacggcgtggccggcgtgagcgccatcagaaaggccgagcccagcctgaaggagcagatcctggagcacgagagcctgggcctgctgagagacgccaccgcctgctacgacagagccatccagctggagcccgaccagatcatccactaccacggcgtggtgaagagcatgctgggcctgggccagctgagcaccgtgatcacccaggtgaacggcgtgcacgccaacagaagcgagtggaccgacgagctgaacacctacagagtggaggccgcctggaagctgagccagtgggacctggtggagaactacctggccgccgacggcaagagcaccacctggagcgtgagactgggccagctgctgctgagcgccaagaagagagacatcaccgccttctacgacagcctgaagctggtgagagccgagcagatcgtgcccctgagcgccgccagcttcgagagaggcagctaccagagaggctacgagtacatcgtgagactgcacatgctgtgcgagctggagcacagcatcaagcccctgttccagcacagccccggcgacagcagccaggaggacagcctgaactgggtggccagactggagatgacccagaacagctacagagccaaggagcccatcctggccctgagaagagccctgctgagcctgaacaagagacccgactacaacgagatggtgggcgagtgctggctgcagagcgccagagtggccagaaaggccggccaccaccagaccgcctacaacgccctgctgaacgccggcgagagcagactggccgagctgtacgtggagagagccaagtggctgtggagcaagggcgacgtgcaccaggccctgatcgtgctgcagaagggcgtggagctgtgcttccccgagaacgagaccccccccgagggcaagaacatgctgatccacggcagagccatgctgctggtgggcagattcatggaggagaccgccaacttcgagagcaacgccatcatgaagaagtacaaggacgtgaccgcctgcctgcccgagtgggaggacggccacttctacctggccaagtactacgacaagctgatgcccatggtgaccgacaacaagatggagaagcagggcgacctgatcagatacatcgtgctgcacttcggcagaagcctgcagtacggcaaccagttcatctaccagagcatgcccagaatgctgaccctgtggctggactacggcaccaaggcctacgagtgggagaaggccggcagaagcgacagagtgcagatgagaaacgacctgggcaagatcaacaaggtgatcaccgagcacaccaactacctggccccctaccagttcctgaccgccttcagccagctgatcagcagaatctgccacagccacgacgaggtgttcgtggtgctgatggagatcatcgccaaggtgttcctggcctacccccagcaggccatgtggatgatgaccgccgtgagcaagagcagctaccccatgagagtgaacagatgcaaggagatcctgaacaaggccatccacatgaagaagagcctggagaagttcgtgggcgacgccaccagactgaccgacaagctgctggagctgtgcaacaagcccgtggacggcagcagcagcaccctgagcatgagcacccacttcaagatgctgaagaagctggtggaggaggccaccttcagcgagatcctgatccccctgcagagcgtgatgatccccaccctgcccagcatcctgggcacccacgccaaccacgccagccacgagcccttccccggccactgggcctacatcgccggcttcgacgacatggtggagatcctggccagcctgcagaagcccaagaagatcagcctgaagggcagcgacggcaagttctacatcatgatgtgcaagcccaaggacgacctgagaaaggactgcagactgatggagttcaacagcctgatcaacaagtgcctgagaaaggacgccgagagcagaagaagagagctgcacatcagaacctacgccgtgatccccctgaacgacgagtgcggcatcatcgagtgggtgaacaacaccgccggcctgagacccatcctgaccaagctgtacaaggagaagggcgtgtacatgaccggcaaggagctgagacagtgcatgctgcccaagagcgccgccctgagcgagaagctgaaggtgttcagagagttcctgctgcccagacacccccccatcttccacgagtggttcctgagaaccttccccgaccccaccagctggtacagcagcagaagcgcctactgcagaagcaccgccgtgatgagcatggtgggctacatcctgggcctgggcgacagacacggcgagaacatcctgttcgacagcctgaccggcgagtgcgtgcacgtggacttcaactgcctgttcaacaagggcgagaccttcgaggtgcccgagatcgtgcccttcagactgacccacaacatggtgaacggcatgggccccatgggcaccgagggcctgttcagaagagcctgcgaggtgaccatgagactgatgagagaccagagagagcccctgatgagcgtgctgaagaccttcctgcacgaccccctggtggagtggagcaagcccgtgaagggccacagcaaggcccccctgaacgagaccggcgaggtggtgaacgagaaggccaagacccacgtgctggacatcgagcagagactgcagggcgtgatcaagaccagaaacagagtgaccggcctgcccctgagcatcgagggccacgtgcactacctgatccaggaggccaccgacgagaacctgctgtgccagatgtacctgggctggaccccctacatgtag

SEQ ID NO: 9412 - DNA, 7743 bp, Artificial Sequence
  Description of Artificial Sequence: Synthetic coding sequence
atgggcgagcacggcctggagctggccagcatgatccccgccctgagagagctgggcagcgccacccccgaggagtacaacaccgtggtgcagaagcccagacagatcctgtgccagttcatcgacagaatcctgaccgacgtgaacgtggtggccgtggagctggtgaagaagaccgacagccagcccaccagcgtgatgctgctggacttcatccagcacatcatgaagagcagccccctgatgttcgtgaacgtgagcggcagccacgaggccaagggcagctgcatcgagttcagcaactggatcatcaccagactgctgagaatcgccgccacccccagctgccacctgctgcacaagaagatctgcgaggtgatctgcagcctgctgttcctgttcaagagcaagagccccgccatcttcggcgtgctgaccaaggagctgctgcagctgttcgaggacctggtgtacctgcacagaagaaacgtgatgggccacgccgtggagtggcccgtggtgatgagcagattcctgagccagctggacgagcacatgggctacctgcagagcgcccccctgcagctgatgagcatgcagaacctggagttcatcgaggtgaccctgctgatggtgctgaccagaatcatcgccatcgtgttcttcagaagacaggagctgctgctgtggcagatcggctgcgtgctgctggagtacggcagccccaagatcaagagcctggccatcagcttcctgaccgagctgttccagctgggcggcctgcccgcccagcccgccagcaccttcttcagcagcttcctggagctgctgaagcacctggtggagatggacaccgaccagctgaagctgtacgaggagcccctgagcaagctgatcaagaccctgttccccttcgaggccgaggcctacagaaacatcgagcccgtgtacctgaacatgctgctggagaagctgtgcgtgatgttcgaggacggcgtgctgatgagactgaagagcgacctgctgaaggccgccctgtgccacctgctgcagtacttcctgaagttcgtgcccgccggctacgagagcgccctgcaggtgagaaaggtgtacgtgagaaacatctgcaaggccctgctggacgtgctgggcatcgaggtggacgccgagtacctgctgggccccctgtacgccgccctgaagatggagagcatggagatcatcgaggagatccagtgccagacccagcaggagaacctgagcagcaacagcgacggcatcagccccaagagaagaagactgagcagcagcctgaaccccagcaagagagcccccaagcagaccgaggacagaaccttcaaggactgccagcacaagagcaagaagaagcccagcgtggtgatcacctggatgagcctggacttctacaccaaggtgctgaagagctgcagaagcctgctggagagcgtgcagaagctggacctggaggccaccatcgacaaggtggtgaagatctacgacgccctgatctacatgcaggtgaacagcagcttcgaggaccacatcctggaggacctgtgcggcatgctgagcctgccctggatctacagccacagcgacgacggctgcctgaagctgaccaccttcgccgccaacctgctgaccctgagctgcagaatcagcgacagctacagcccccaggcccagagcagatgcgtgttcctgctgaccctgttccccagaagaatcttcctggagtggagaaccgccgtgtacaactgggccctgcagagcagccacgaggtgatcagagccagctgcgtgagcggcttcttcatcctgctgcagcagcagaacagctgcaacagagtgcccaagatcctgatcgacaaggtgaaggacgacagcgacatcgtgaagaaggagttcgccagcatcctgggccagctggtgtgcaccctgcacggcatgttctacctgaccagcagcctgaccgagcccttcagcgagcacggccacgtggacctgttctgcagaaacctgaaggccaccagccagcacgagtgcagcagcagccagctgaaggccagcgtgtgcaagcccttcctgttcctgctgaagaagaagatccccagccccgtgaagctggccttcatcgacaacctgcaccacctgtgcaagcacctggacttcagagaggacgagaccgacgtgaaggccgtgctgggcaccctgctgaacctgatggaggaccccgacaaggacgtgagagtggccttcagcggcaacatcaagcacatcctggagagcctggacagcgaggacggcttcatcaaggagctgttcgtgctgagaatgaaggaggcctacacccacgcccagatcagcagaaacaacgagctgaaggacaccctgatcctgaccaccggcgacatcggcagagccgccaagggcgacctggtgcccttcgccctgctgcacctgctgcactgcctgctgagcaagagcgccagcgtgagcggcgccgcctacaccgagatcagagccctggtggccgccaagagcgtgaagctgcagagcttcttcagccagtacaagaagcccatctgccagttcctggtggagagcctgcacagcagccagatgaccgccctgcccaacaccccctgccagaacgccgacgtgagaaagcaggacgtggcccaccagagagagatggccctgaacaccctgagcgagatcgccaacgtgttcgacttccccgacctgaacagattcctgaccagaaccctgcaggtgctgctgcccgacctggccgccaaggccagccccgccgccagcgccctgatcagaaccctgggcaagcagctgaacgtgaacagaagagagatcctgatcaacaacttcaagtacatcttcagccacctggtgtgcagctgcagcaaggacgagctggagagagccctgcactacctgaagaacgagaccgagatcgagctgggcagcctgctgagacaggacttccagggcctgcacaacgagctgctgctgagaatcggcgagcactaccagcaggtgttcaacggcctgagcatcctggccagcttcgccagcagcgacgacccctaccagggccccagagacatcatcagccccgagctgatggccgactacctgcagcccaagctgctgggcatcctggccttcttcaacatgcagctgctgagcagcagcgtgggcatcgaggacaagaagatggccctgaacagcctgatgagcctgatgaagctgatgggccccaagcacgtgagcagcgtgagagtgaagatgatgaccaccctgagaaccggcctgagattcaaggacgacttccccgagctgtgctgcagagcctgggactgcttcgtgagatgcctggaccacgcctgcctgggcagcctgctgagccacgtgatcgtggccctgctgcccctgatccacatccagcccaaggagaccgccgccatcttccactacctgatcatcgagaacagagacgccgtgcaggacttcctgcacgagatctacttcctgcccgaccaccccgagctgaagaagatcaaggccgtgctgcaggagtacagaaaggagaccagcgagagcaccgacctgcagaccaccctgcagctgagcatgaaggccatccagcacgagaacgtggacgtgagaatccacgccctgaccagcctgaaggagaccctgtacaagaaccaggagaagctgatcaagtacgccaccgacagcgagaccgtggagcccatcatcagccagctggtgaccgtgctgctgaagggctgccaggacgccaacagccaggccagactgctgtgcggcgagtgcctgggcgagctgggcgccatcgaccccggcagactggacttcagcaccaccgagacccagggcaaggacttcaccttcgtgaccggcgtggaggacagcagcttcgcctacggcctgctgatggagctgaccagagcctacctggcctacgccgacaacagcagagcccaggacagcgccgcctacgccatccaggagctgctgagcatctacgactgcagagagatggagaccaacggccccggccaccagctgtggagaagattccccgagcacgtgagagagatcctggagccccacctgaacaccagatacaagagcagccagaagagcaccgactggagcggcgtgaagaagcccatctacctgagcaagctgggcagcaacttcgccgagtggagcgccagctgggccggctacctgatcaccaaggtgagacacgacctggccagcaagatcttcacctgctgcagcatcatgatgaagcacgacttcaaggtgaccatctacctgctgccccacatcctggtgtacgtgctgctgggctgcaaccaggaggaccagcaggaggtgtacgccgagatcatggccgtgctgaagcacgacgaccagcacaccatcaacacccaggacatcgccagcgacctgtgccagctgagcacccagaccgtgttcagcatgctggaccacctgacccagtgggccagacacaagttccaggccctgaaggccgagaagtgcccccacagcaagagcaacagaaacaaggtggacagcatggtgagcaccgtggactacgaggactaccagagcgtgaccagattcctggacctgatcccccaggacaccctggccgtggccagcttcagaagcaaggcctacaccagagccgtgatgcacttcgagagcttcatcaccgagaagaagcagaacatccaggagcacctgggcttcctgcagaagctgtacgccgccatgcacgagcccgacggcgtggccggcgtgagcgccatcagaaaggccgagcccagcctgaaggagcagatcctggagcacgagagcctgggcctgctgagagacgccaccgcctgctacgacagagccatccagctggagcccgaccagatcatccactaccacggcgtggtgaagagcatgctgggcctgggccagctgagcaccgtgatcacccaggtgaacggcgtgcacgccaacagaagcgagtggaccgacgagctgaacacctacagagtggaggccgcctggaagctgagccagtgggacctggtggagaactacctggccgccgacggcaagagcaccacctggagcgtgagactgggccagctgctgctgagcgccaagaagagagacatcaccgccttctacgacagcctgaagctggtgagagccgagcagatcgtgcccctgagcgccgccagcttcgagagaggcagctaccagagaggctacgagtacatcgtgagactgcacatgctgtgcgagctggagcacagcatcaagcccctgttccagcacagccccggcgacagcagccaggaggacagcctgaactgggtggccagactggagatgacccagaacagctacagagccaaggagcccatcctggccctgagaagagccctgctgagcctgaacaagagacccgactacaacgagatggtgggcgagtgctggctgcagagcgccagagtggccagaaaggccggccaccaccagaccgcctacaacgccctgctgaacgccggcgagagcagactggccgagctgtacgtggagagagccaagtggctgtggagcaagggcgacgtgcaccaggccctgatcgtgctgcagaagggcgtggagctgtgcttccccgagaacgagaccccccccgagggcaagaacatgctgatccacggcagagccatgctgctggtgggcagattcatggaggagaccgccaacttcgagagcaacgccatcatgaagaagtacaaggacgtgaccgcctgcctgcccgagtgggaggacggccacttctacctggccaagtactacgacaagctgatgcccatggtgaccgacaacaagatggagaagcagggcgacctgatcagatacatcgtgctgcacttcggcagaagcctgcagtacggcaaccagttcatctaccagagcatgcccagaatgctgaccctgtggctggactacggcaccaaggcctacgagtgggagaaggccggcagaagcgacagagtgcagatgagaaacgacctgggcaagatcaacaaggtgatcaccgagcacaccaactacctggccccctaccagttcctgaccgccttcagccagctgatcagcagaatctgccacagccacgacgaggtgttcgtggtgctgatggagatcatcgccaaggtgttcctggcctacccccagcaggccatgtggatgatgaccgccgtgagcaagagcagctaccccatgagagtgaacagatgcaaggagatcctgaacaaggccatccacatgaagaagagcctggagaagttcgtgggcgacgccaccagactgaccgacaagctgctggagctgtgcaacaagcccgtggacggcagcagcagcaccctgagcatgagcacccacttcaagatgctgaagaagctggtggaggaggccaccttcagcgagatcctgatccccctgcagagcgtgatgatccccaccctgcccagcatcctgggcacccacgccaaccacgccagccacgagcccttccccggccactgggcctacatcgccggcttcgacgacatggtggagatcctggccagcctgcagaagcccaagaagatcagcctgaagggcagcgacggcaagttctacatcatgatgtgcaagcccaaggacgacctgagaaaggactgcagactgatggagttcaacagcctgatcaacaagtgcctgagaaaggacgccgagagcagaagaagagagctgcacatcagaacctacgccgtgatccccctgaacgacgagtgcggcatcatcgagtgggtgaacaacaccgccggcctgagacccatcctgaccaagctgtacaaggagaagggcgtgtacatgaccggcaaggagctgagacagtgcatgctgcccaagagcgccgccctgagcgagaagctgaaggtgttcagagagttcctgctgcccagacacccccccatcttccacgagtggttcctgagaaccttccccgaccccaccagctggtacagcagcagaagcgcctactgcagaagcaccgccgtgatgagcatggtgggctacatcctgggcctgggcgacagacacggcgagaacatcctgttcgacagcctgaccggcgagtgcgtgcacgtggacttcaactgcctgttcaacaagggcgagaccttcgaggtgcccgagatcgtgcccttcagactgacccacaacatggtgaacggcatgggccccatgggcaccgagggcctgttcagaagagcctgcgaggtgaccatgagactgatgagagaccagagagagcccctgatgagcgtgctgaagaccttcctgcacgaccccctggtggagtggagcaagcccgtgaagggccacagcaaggcccccctgaacgagaccggcgaggtggtgaacgagaaggccaagacccacgtgctggacatcgagcagagactgcagggcgtgatcaagaccagaaacagagtgaccggcctgcccctgagcatcgagggccacgtgcactacctgatccaggaggccaccgacgagaacctgctgtgccagatgtacctgggctggaccccctacatgtag

SEQ ID NO: 9413 - DNA, 9171 bp, Artificial Sequence
  Description of Artificial Sequence: Synthetic coding sequence
atgagcctggtgctgaacgacctgctgatctgctgcagacagctggagcacgacagagccaccgagagaaagaaggaggtggagaagttcaagagactgatcagagaccccgagaccatcaagcacctggacagacacagcgacagcaagcagggcaagtacctgaactgggacgccgtgttcagattcctgcagaagtacatccagaaggagaccgagtgcctgagaatcgccaagcccaacgtgagcgccagcacccaggccagcagacagaagaagatgcaggagatcagcagcctggtgaagtacttcatcaagtgcgccaacagaagagcccccagactgaagtgccaggagctgctgaactacatcatggacaccgtgaaggacagcagcaacggcgccatctacggcgccgactgcagcaacatcctgctgaaggacatcctgagcgtgagaaagtactggtgcgagatcagccagcagcagtggctggagctgttcagcgtgtacttcagactgtacctgaagcccagccaggacgtgcacagagtgctggtggccagaatcatccacgccgtgaccaagggctgctgcagccagaccgacggcctgaacagcaagttcctggacttcttcagcaaggccatccagtgcgccagacaggagaagagcagcagcggcctgaaccacatcctggccgccctgaccatcttcctgaagaccctggccgtgaacttcagaatcagagtgtgcgagctgggcgacgagatcctgcccaccctgctgtacatctggacccagcacagactgaacgacagcctgaaggaggtgatcatcgagctgttccagctgcagatctacatccaccaccccaagggcgccaagacccaggagaagggcgcctacgagagcaccaagtggagaagcatcctgtacaacctgtacgacctgctggtgaacgagatcagccacatcggcagcagaggcaagtacagcagcggcttcagaaacatcgccgtgaaggagaacctgatcgagctgatggccgacatctgccaccaggtgttcaacgaggacaccagaagcctggagatcagccagagctacaccaccacccagagagagagcagcgactacagcgtgccctgcaagagaaagaagatcgagctgggctgggaggtgatcaaggaccacctgcagaagagccagaacgacttcgacctggtgccctggctgcagatcgccacccagctgatcagcaagtaccccgccagcctgcccaactgcgagctgagccccctgctgatgatcctgagccagctgctgccccagcagagacacggcgagagaaccccctacgtgctgagatgcctgaccgaggtggccctgtgccaggacaagagaagcaacctggagagcagccagaagagcgacctgctgaagctgtggaacaagatctggtgcatcaccttcagaggcatcagcagcgagcagatccaggccgagaacttcggcctgctgggcgccatcatccagggcagcctggtggaggtggacagagagttctggaagctgttcaccggcagcgcctgcagacccagctgccccgccgtgtgctgcctgaccctggccctgaccaccagcatcgtgcccggcaccgtgaagatgggcatcgagcagaacatgtgcgaggtgaacagaagcttcagcctgaaggagagcatcatgaagtggctgctgttctaccagctggagggcgacctggagaacagcaccgaggtgccccccatcctgcacagcaacttcccccacctggtgctggagaagatcctggtgagcctgaccatgaagaactgcaaggccgccatgaacttcttccagagcgtgcccgagtgcgagcaccaccagaaggacaaggaggagctgagcttcagcgaggtggaggagctgttcctgcagaccaccttcgacaagatggacttcctgaccatcgtgagagagtgcggcatcgagaagcaccagagcagcatcggcttcagcgtgcaccagaacctgaaggagagcctggacagatgcctgctgggcctgagcgagcagctgctgaacaactacagcagcgagatcaccaacagcgagaccctggtgagatgcagcagactgctggtgggcgtgctgggctgctactgctacatgggcgtgatcgccgaggaggaggcctacaagagcgagctgttccagaaggccaagagcctgatgcagtgcgccggcgagagcatcaccctgttcaagaacaagaccaacgaggagttcagaatcggcagcctgagaaacatgatgcagctgtgcaccagatgcctgagcaactgcaccaagaagagccccaacaagatcgccagcggcttcttcctgagactgctgaccagcaagctgatgaacgacatcgccgacatctgcaagagcctggccagcttcatcaagaagcccttcgacagaggcgaggtggagagcatggaggacgacaccaacggcaacctgatggaggtggaggaccagagcagcatgaacctgttcaacgactaccccgacagcagcgtgagcgacgccaacgagcccggcgagagccagagcaccatcggcgccatcaaccccctggccgaggagtacctgagcaagcaggacctgctgttcctggacatgctgaagttcctgtgcctgtgcgtgaccaccgcccagaccaacaccgtgagcttcagagccgccgacatcagaagaaagctgctgatgctgatcgacagcagcaccctggagcccaccaagagcctgcacctgcacatgtacctgatgctgctgaaggagctgcccggcgaggagtaccccctgcccatggaggacgtgctggagctgctgaagcccctgagcaacgtgtgcagcctgtacagaagagaccaggacgtgtgcaagaccatcctgaaccacgtgctgcacgtggtgaagaacctgggccagagcaacatggacagcgagaacaccagagacgcccagggccagttcctgaccgtgatcggcgccttctggcacctgaccaaggagagaaagtacatcttcagcgtgagaatggccctggtgaactgcctgaagaccctgctggaggccgacccctacagcaagtgggccatcctgaacgtgatgggcaaggacttccccgtgaacgaggtgttcacccagttcctggccgacaaccaccaccaggtgagaatgctggccgccgagagcatcaacagactgttccaggacaccaagggcgacagcagcagactgctgaaggccctgcccctgaagctgcagcagaccgccttcgagaacgcctacctgaaggcccaggagggcatgagagagatgagccacagcgccgagaaccccgagaccctggacgagatctacaacagaaagagcgtgctgctgaccctgatcgccgtggtgctgagctgcagccccatctgcgagaagcaggccctgttcgccctgtgcaagagcgtgaaggagaacggcctggagccccacctggtgaagaaggtgctggagaaggtgagcgagaccttcggctacagaagactggaggacttcatggccagccacctggactacctggtgctggagtggctgaacctgcaggacaccgagtacaacctgagcagcttccccttcatcctgctgaactacaccaacatcgaggacttctacagaagctgctacaaggtgctgatcccccacctggtgatcagaagccacttcgacgaggtgaagagcatcgccaaccagatccaggaggactggaagagcctgctgaccgactgcttccccaagatcctggtgaacatcctgccctacttcgcctacgagggcaccagagacagcggcatggcccagcagagagagaccgccaccaaggtgtacgacatgctgaagagcgagaacctgctgggcaagcagatcgaccacctgttcatcagcaacctgcccgagatcgtggtggagctgctgatgaccctgcacgagcccgccaacagcagcgccagccagagcaccgacctgtgcgacttcagcggcgacctggaccccgcccccaaccccccccacttccccagccacgtgatcaaggccaccttcgcctacatcagcaactgccacaagaccaagctgaagagcatcctggagatcctgagcaagagccccgacagctaccagaagatcctgctggccatctgcgagcaggccgccgagaccaacaacgtgtacaagaagcacagaatcctgaagatctaccacctgttcgtgagcctgctgctgaaggacatcaagagcggcctgggcggcgcctgggccttcgtgctgagagacgtgatctacaccctgatccactacatcaaccagagacccagctgcatcatggacgtgagcctgagaagcttcagcctgtgctgcgacctgctgagccaggtgtgccagaccgccgtgacctactgcaaggacgccctggagaaccacctgcacgtgatcgtgggcaccctgatccccctggtgtacgagcaggtggaggtgcagaagcaggtgctggacctgctgaagtacctggtgatcgacaacaaggacaacgagaacctgtacatcaccatcaagctgctggaccccttccccgaccacgtggtgttcaaggacctgagaatcacccagcagaagatcaagtacagcagaggccccttcagcctgctggaggagatcaaccacttcctgagcgtgagcgtgtacgacgccctgcccctgaccagactggagggcctgaaggacctgagaagacagctggagctgcacaaggaccagatggtggacatcatgagagccagccaggacaacccccaggacggcatcatggtgaagctggtggtgaacctgctgcagctgagcaagatggccatcaaccacaccggcgagaaggaggtgctggaggccgtgggcagctgcctgggcgaggtgggccccatcgacttcagcaccatcgccatccagcacagcaaggacgccagctacaccaaggccctgaagctgttcgaggacaaggagctgcagtggaccttcatcatgctgacctacctgaacaacaccctggtggaggactgcgtgaaggtgagaagcgccgccgtgacctgcctgaagaacatcctggccaccaagaccggccacagcttctgggagatctacaagatgaccaccgaccccatgctggcctacctgcagcccttcagaaccagcagaaagaagttcctggaggtgcccagattcgacaaggagaaccccttcgagggcctggacgacatcaacctgtggatccccctgagcgagaaccacgacatctggatcaagaccctgacctgcgccttcctggacagcggcggcaccaagtgcgagatcctgcagctgctgaagcccatgtgcgaggtgaagaccgacttctgccagaccgtgctgccctacctgatccacgacatcctgctgcaggacaccaacgagagctggagaaacctgctgagcacccacgtgcagggcttcttcaccagctgcctgagacacttcagccagaccagcagaagcaccacccccgccaacctggacagcgagagcgagcacttcttcagatgctgcctggacaagaagagccagagaaccatgctggccgtggtggactacatgagaagacagaagagacccagcagcggcaccatcttcaacgacgccttctggctggacctgaactacctggaggtggccaaggtggcccagagctgcgccgcccacttcaccgccctgctgtacgccgagatctacgccgacaagaagagcatggacgaccaggagaagagaagcctggccttcgaggagggcagccagaacaccaccatcagcagcctgagcgagaagagcaaggaggagaccggcatcagcctgcaggacctgctgctggagatctacagaagcatcggcgagcccgacagcctgtacggctgcggcggcggcaagatgctgcagcccatcaccagactgagaacctacgagcacgaggccatgtggggcaaggccctggtgacctacgacctggagaccgccatccccagcagcaccagacaggccggcatcatccaggccctgcagaacctgggcctgtgccacatcctgagcgtgtacctgaagggcctggactacgagaacaaggactggtgccccgagctggaggagctgcactaccaggccgcctggagaaacatgcagtgggaccactgcaccagcgtgagcaaggaggtggagggcaccagctaccacgagagcctgtacaacgccctgcagagcctgagagacagagagttcagcaccttctacgagagcctgaagtacgccagagtgaaggaggtggaggagatgtgcaagagaagcctggagagcgtgtacagcctgtaccccaccctgagcagactgcaggccatcggcgagctggagagcatcggcgagctgttcagcagaagcgtgacccacagacagctgagcgaggtgtacatcaagtggcagaagcacagccagctgctgaaggacagcgacttcagcttccaggagcccatcatggccctgagaaccgtgatcctggagatcctgatggagaaggagatggacaacagccagagagagtgcatcaaggacatcctgaccaagcacctggtggagctgagcatcctggccagaaccttcaagaacacccagctgcccgagagagccatcttccagatcaagcagtacaacagcgtgagctgcggcgtgagcgagtggcagctggaggaggcccaggtgttctgggccaagaaggagcagagcctggccctgagcatcctgaagcagatgatcaagaagctggacgccagctgcgccgccaacaaccccagcctgaagctgacctacaccgagtgcctgagagtgtgcggcaactggctggccgagacctgcctggagaaccccgccgtgatcatgcagacctacctggagaaggccgtggaggtggccggcaactacgacggcgagagcagcgacgagctgagaaacggcaagatgaaggccttcctgagcctggccagattcagcgacacccagtaccagagaatcgagaactacatgaagagcagcgagttcgagaacaagcaggccctgctgaagagagccaaggaggaggtgggcctgctgagagagcacaagatccagaccaacagatacaccgtgaaggtgcagagagagctggagctggacgagctggccctgagagccctgaaggaggacagaaagagattcctgtgcaaggccgtggagaactacatcaactgcctgctgagcggcgaggagcacgacatgtgggtgttcagactgtgcagcctgtggctggagaacagcggcgtgagcgaggtgaacggcatgatgaagagagacggcatgaagatccccacctacaagttcctgcccctgatgtaccagctggccgccagaatgggcaccaagatgatgggcggcctgggcttccacgaggtgctgaacaacctgatcagcagaatcagcatggaccacccccaccacaccctgttcatcatcctggccctggccaacgccaacagagacgagttcctgaccaagcccgaggtggccagaagaagcagaatcaccaagaacgtgcccaagcagagcagccagctggacgaggacagaaccgaggccgccaacagaatcatctgcaccatcagaagcagaagaccccagatggtgagaagcgtggaggccctgtgcgacgcctacatcatcctggccaacctggacgccacccagtggaagacccagagaaagggcatcaacatccccgccgaccagcccatcaccaagctgaagaacctggaggacgtggtggtgcccaccatggagatcaaggtggaccacaccggcgagtacggcaacctggtgaccatccagagcttcaaggccgagttcagactggccggcggcgtgaacctgcccaagatcatcgactgcgtgggcagcgacggcaaggagagaagacagctggtgaagggcagagacgacctgagacaggacgccgtgatgcagcaggtgttccagatgtgcaacaccctgctgcagagaaacaccgagaccagaaagagaaagctgaccatctgcacctacaaggtggtgcccctgagccagagaagcggcgtgctggagtggtgcaccggcaccgtgcccatcggcgagttcctggtgaacaacgaggacggcgcccacaagagatacagacccaacgacttcagcgccttccagtgccagaagaagatgatggaggtgcagaagaagagcttcgaggagaagtacgaggtgttcatggacgtgtgccagaacttccagcccgtgttcagatacttctgcatggagaagttcctggaccccgccatctggttcgagaagagactggcctacaccagaagcgtggccaccagcagcatcgtgggctacatcctgggcctgggcgacagacacgtgcagaacatcctgatcaacgagcagagcgccgagctggtgcacatcgacctgggcgtggccttcgagcagggcaagatcctgcccacccccgagaccgtgcccttcagactgaccagagacatcgtggacggcatgggcatcaccggcgtggagggcgtgttcagaagatgctgcgagaagaccatggaggtgatgagaaacagccaggagaccctgctgaccatcgtggaggtgctgctgtacgaccccctgttcgactggaccatgaaccccctgaaggccctgtacctgcagcagagacccgaggacgagaccgagctgcaccccaccctgaacgccgacgaccaggagtgcaagagaaacctgagcgacatcgaccagagcttcaacaaggtggccgagagagtgctgatgagactgcaggagaagctgaagggcgtggaggagggcaccgtgctgagcgtgggcggccaggtgaacctgctgatccagcaggccatcgaccccaagaacctgagcagactgttccccggctggaaggcctgggtgtag

SEQ ID NO: 9414 - DNA, 417 bp, Artificial Sequence
  Description of Artificial Sequence: Synthetic coding sequence
atgaccctgcacgagcccgccaacagcagcgccagccagagcaccgacctgtgcgacttcagcggcgacctggaccccgcccccaaccccccccacttccccagccacgtgatcaaggccaccttcgcctacatcagcaactgccacaagaccaagctgaagagcatcctggagatcctgagcaagagccccgacagctaccagaagatcctgctggccatctgcgagcaggccgccgagaccaacaacgtgtacaagaagcacagaatcctgaagatctaccacctgttcgtgagcctgctgctgaaggacatcaagagcggcctgggcggcgcctgggccttcgtgctgagagacgtgatctacaccctgatccactacatcaaccagagaaagctgaccatcttcagccagtag

SEQ ID NO: 9415 - DNA, 9171 bp, Artificial Sequence; identical to SEQ ID NO: 9413
  Description of Artificial Sequence: Synthetic coding sequence

SEQ ID NO: 9416 - DNA, 4110 bp, Artificial Sequence
  Description of Artificial Sequence: Synthetic coding sequence
atgagcctggtgctgaacgacctgctgatctgctgcagacagctggagcacgacagagccaccgagagaaagaaggaggtggagaagttcaagagactgatcagagaccccgagaccatcaagcacctggacagacacagcgacagcaagcagggcaagtacctgaactgggacgccgtgttcagattcctgcagaagtacatccagaaggagaccgagtgcctgagaatcgccaagcccaacgtgagcgccagcacccaggccagcagacagaagaagatgcaggagatcagcagcctggtgaagtacttcatcaagtgcgccaacagaagagcccccagactgaagtgccaggagctgctgaactacatcatggacaccgtgaaggacagcagcaacggcgccatctacggcgccgactgcagcaacatcctgctgaaggacatcctgagcgtgagaaagtactggtgcgagatcagccagcagcagtggctggagctgttcagcgtgtacttcagactgtacctgaagcccagccaggacgtgcacagagtgctggtggccagaatcatccacgccgtgaccaagggctgctgcagccagaccgacggcctgaacagcaagttcctggacttcttcagcaaggccatccagtgcgccagacaggagaagagcagcagcggcctgaaccacatcctggccgccctgaccatcttcctgaagaccctggccgtgaacttcagaatcagagtgtgcgagctgggcgacgagatcctgcccaccctgctgtacatctggacccagcacagactgaacgacagcctgaaggaggtgatcatcgagctgttccagctgcagatctacatccaccaccccaagggcgccaagacccaggagaagggcgcctacgagagcaccaagtggagaagcatcctgtacaacctgtacgacctgctggtgaacgagatcagccacatcggcagcagaggcaagtacagcagcggcttcagaaacatcgccgtgaaggagaacctgatcgagctgatggccgacatctgccaccaggtgttcaacgaggacaccagaagcctggagatcagccagagctacaccaccacccagagagagagcagcgactacagcgtgccctgcaagagaaagaagatcgagctgggctgggaggtgatcaaggaccacctgcagaagagccagaacgacttcgacctggtgccctggctgcagatcgccacccagctgatcagcaagtaccccgccagcctgcccaactgcgagctgagccccctgctgatgatcctgagccagctgctgccccagcagagacacggcgagagaaccccctacgtgctgagatgcctgaccgaggtggccctgtgccaggacaagagaagcaacctggagagcagccagaagagcgacctgctgaagctgtggaacaagatctggtgcatcaccttcagaggcatcagcagcgagcagatccaggccgagaacttcggcctgctgggcgccatcatccagggcagcctggtggaggtggacagagagttctggaagctgttcaccggcagcgcctgcagacccagctgccccgccgtgtgctgcctgaccctggccctgaccaccagcatcgtgcccggcaccgtgaagatgggcatcgagcagaacatgtgcgaggtgaacagaagcttcagcctgaaggagagcatcatgaagtggctgctgttctaccagctggagggcgacctggagaacagcaccgaggtgccccccatcctgcacagcaacttcccccacctggtgctggagaagatcctggtgagcctgaccatgaagaactgcaaggccgccatgaacttcttccagagcgtgcccgagtgcgagcaccaccagaaggacaaggaggagctgagcttcagcgaggtggaggagctgttcctgcagaccaccttcgacaagatggacttcctgaccatcgtgagagagtgcggcatcgagaagcaccagagcagcatcggcttcagcgtgcaccagaacctgaaggagagcctggacagatgcctgctgggcctgagcgagcagctgctgaacaactacagcagcgagatcaccaacagcgagaccctggtgagatgcagcagactgctggtgggcgtgctgggctgctactgctacatgggcgtgatcgccgaggaggaggcctacaagagcgagctgttccagaaggccaagagcctgatgcagtgcgccggcgagagcatcaccctgttcaagaacaagaccaacgaggagttcagaatcggcagcctgagaaacatgatgcagctgtgcaccagatgcctgagcaactgcaccaagaagagccccaacaagatcgccagcggcttcttcctgagactgctgaccagcaagctgatgaacgacatcgccgacatctgcaagagcctggccagcttcatcaagaagcccttcgacagaggcgaggtggagagcatggaggacgacaccaacggcaacctgatggaggtggaggaccagagcagcatgaacctgttcaacgactaccccgacagcagcgtgagcgacgccaacgagcccggcgagagccagagcaccatcggcgccatcaaccccctggccgaggagtacctgagcaagcaggacctgctgttcctggacatgctgaagttcctgtgcctgtgcgtgaccaccgcccagaccaacaccgtgagcttcagagccgccgacatcagaagaaagctgctgatgctgatcgacagcagcaccctggagcccaccaagagcctgcacctgcacatgtacctgatgctgctgaaggagctgcccggcgaggagtaccccctgcccatggaggacgtgctggagctgctgaagcccctgagcaacgtgtgcagcctgtacagaagagaccaggacgtgtgcaagaccatcctgaaccacgtgctgcacgtggtgaagaacctgggccagagcaacatggacagcgagaacaccagagacgcccagggccagttcctgaccgtgatcggcgccttctggcacctgaccaaggagagaaagtacatcttcagcgtgagaatggccctggtgaactgcctgaagaccctgctggaggccgacccctacagcaagtgggccatcctgaacgtgatgggcaaggacttccccgtgaacgaggtgttcacccagttcctggccgacaaccaccaccaggtgagaatgctggccgccgagagcatcaacagactgttccaggacaccaagggcgacagcagcagactgctgaaggccctgcccctgaagctgcagcagaccgccttcgagaacgcctacctgaaggcccaggagggcatgagagagatgagccacagcgccgagaaccccgagaccctggacgagatctacaacagaaagagcgtgctgctgaccctgatcgccgtggtgctgagctgcagccccatctgcgagaagcaggccctgttcgccctgtgcaagagcgtgaaggagaacggcctggagccccacctggtgaagaaggtgctggagaaggtgagcgagaccttcggctacagaagactggaggacttcatggccagccacctggactacctggtgctggagtggctgaacctgcaggacaccgagtacaacctgagcagcttccccttcatcctgctgaactacaccaacatcgaggacttctacagaagctgctacaaggtgctgatcccccacctggtgatcagaagccacttcgacgaggtgaagagcatcgccaaccagatccaggaggactggaagagcctgctgaccgactgcttccccaagatcctggtgaacatcctgccctacttcgcctacgagggcaccagagacagcggcatggcccagcagagagagaccgccaccaaggtgtacgacatgctgaagagcgagaacctgctgggcaagcagatcgaccacctgttcatcagcaacctgcccgagatcgtggtggagctgctgatgaccctgcacgagcccgccaacagcagcgccagccagagcaccgacctgtgcgacttcagctag

SEQ ID NO: 9417 - DNA, 282 bp, Artificial Sequence
  Description of Artificial Sequence: Synthetic coding sequence
atgagcctggtgctgaacgacctgctgatctgctgcagacagctggagcacgacagagccaccgagagaaagaaggaggtggagaagttcaagagactgatcagagaccccgagaccatcaagcacctggacagacacagcgacagcaagcagggcaagtacctgaactgggacgccgtgttcagattcctgcagaagtacatccagaaggagaccgagtgcctgagaatcgccaagcccaacgtgagcgccagcacccaggccagcagacagaagaagtag

SEQ ID NO: 9418 - DNA, 921 bp, Artificial Sequence
  Description of Artificial Sequence: Synthetic coding sequence
atggagagcatcttccacgagaagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaagcagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9419 - DNA, 1110 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaaggaccagcacttccacatcctgaagcagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9420 - DNA, 1086 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaagcagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9421 - DNA, 1101 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaacgactacttcgacagccagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9422 - DNA, 1065 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaaggaccagcacttccacatcctgaagcagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9423 - DNA, 1113 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaagaccgagagcagaagcgtggcccaggcccagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9424 - DNA, 1041 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaagcagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9425 - DNA, 1095 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaagcagcagcagaagcagcagcagcagcagcagcagcagcagcagggcgacctgagcggccagagcagccacccctgcgagagacccgccaccagcagcggcgccctgggcagcgacctgggcaaggcctgcagccccttcatcatgttcgccaccttcaccctgtacctgacctacgagctgcacgtgatcttcgccctgcactacagcagcttccccctgtag

SEQ ID NO: 9426 - DNA, 1119 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaagttcggcagacccagaagagccgactgcctgagacagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9427 - DNA, 1128 bp, Artificial Sequence
  Description of Artificial Sequence: Synthetic coding sequence
gacagcgtgagcaagaagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaagaagttcaccgccaacagaaccgaccagcacttccacatcctgaagcagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9428 - DNA, 1125 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaaggtgttcttcaagaacctgcagcagatcggcagagccagacagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9429 - DNA, 1113 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaagatctacttcaccttcgagtgcttcagacagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9430 - DNA, 1134 bp, Artificial Sequence
  Description of Artificial Sequence: Synthetic coding sequence
atggagagcatcttccacgagaagcaggagggcagcctgtgcgcccagcactgcctgaacaacctgctgcagggcgagtacttcagccccgtggagctgagcagcatcgcccaccagctggacgaggaggagagaatgagaatggccgagggcggcgtgaccagcgaggactacagaaccttcctgcagcagcccagcggcaacatggacgacagcggcttcttcagcatccaggtgatcagcaacgccctgaaggtgtggggcctggagctgatcctgttcaacagccccgagtaccagagactgagaatcgaccccatcaacgagagaagcttcatctgcaactacaaggagcactggttcaccgtgagaaagctgggcaagcagtggttcaacctgaacagcctgctgaccggccccgagctgatcagcgacacctacctggccctgttcctggcccagctgcagcaggagggctacagcatcttcgtggtgaagggcgacctgcccgactgcgaggccgaccagctgctgcagatgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaaggtgttcttcaagaacctgcagcagaaccagcacttccacatcctgaagcagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9431 - DNA, 549 bp, Artificial Sequence
  Description of Artificial Sequence: Synthetic coding sequence
atgatcagagtgcagcagatgcacagacccaagctgatcggcgaggagctggcccagctgaaggagcagagagtgcacaagaccgacctggagagagtgctggaggccaacgacggcagcggcatgctggacgaggacgaggaggacctgcagagagccctggccctgagcagacaggagatcgacatggaggacgaggaggccgacctgagaagagccatccagctgagcatgcagggcagcagcagaaacatcagccaggacatgacccagaccagcggcaccaacctgaccagcgaggagctgagaaagagaagagaggcctacttcgagaagcagcagcagaagcagcagcagcagcagcagcagcagcagcagggcgacctgagcggccagagcagccacccctgcgagagacccgccaccagcagcggcgccctgggcagcgacctgggcgacgccatgagcgaggaggacatgctgcaggccgccgtgaccatgagcctggagaccgtgagaaacgacctgaagaccgagggcaagaagtag

SEQ ID NO: 9432 - DNA, 3306 bp, Artificial Sequence
  Description of Artificial Sequence: Synthetic coding sequence
atgagcgccaaggccatcagcgagcagaccggcaaggagctgctgtacaagttcatctgcaccaccagcgccatccagaacagattcaagtacgccagagtgacccccgacaccgactgggccagactgctgcaggaccacccctggctgctgagccagaacctggtggtgaagcccgaccagctgatcaagagaagaggcaagctgggcctggtgggcgtgaacctgaccctggacggcgtgaagagctggctgaagcccagactgggccaggaggccaccgtgggcaaggccaccggcttcctgaagaacttcctgatcgagcccttcgtgccccacagccaggccgaggagttctacgtgtgcatctacgccaccagagagggcgactacgtgctgttccaccacgagggcggcgtggacgtgggcgacgtggacgccaaggcccagaagctgctggtgggcgtggacgagaagctgaaccccgaggacatcaagaagcacctgctggtgcacgcccccgaggacaagaaggagatcctggccagcttcatcagcggcctgttcaacttctacgaggacctgtacttcacctacctggagatcaaccccctggtggtgaccaaggacggcgtgtacgtgctggacctggccgccaaggtggacgccaccgccgactacatctgcaaggtgaagtggggcgacatcgagttccccccccccttcggcagagaggcctaccccgaggaggcctacatcgccgacctggacgccaagagcggcgccagcctgaagctgaccctgctgaaccccaagggcagaatctggaccatggtggccggcggcggcgccagcgtggtgtacagcgacaccatctgcgacctgggcggcgtgaacgagctggccaactacggcgagtacagcggcgcccccagcgagcagcagacctacgactacgccaagaccatcctgagcctgatgaccagagagaagcaccccgacggcaagatcctgatcatcggcggcagcatcgccaacttcaccaacgtggccgccaccttcaagggcatcgtgagagccatcagagactaccagggccccctgaaggagcacgaggtgaccatcttcgtgagaagaggcggccccaactaccaggagggcctgagagtgatgggcgaggtgggcaagaccaccggcatccccatccacgtgttcggcaccgagacccacatgaccgccatcgtgggcatggccctgggccacagacccatccccaaccagccccccaccgccgcccacaccgccaacttcctgctgaacgccagcggcagcaccagcacccccgcccccagcagaaccgccagcttcagcgagagcagagccgacgaggtggcccccgccaagaaggccaagcccgccatgccccaggacagcgtgcccagccccagaagcctgcagggcaagagcaccaccctgttcagcagacacaccaaggccatcgtgtggggcatgcagaccagagccgtgcagggcatgctggacttcgactacgtgtgcagcagagacgagcccagcgtggccgccatggtgtaccccttcaccggcgaccacaagcagaagttctactggggccacaaggagatcctgatccccgtgttcaagaacatggccgacgccatgagaaagcaccccgaggtggacgtgctgatcaacttcgccagcctgagaagcgcctacgacagcaccatggagaccatgaactacgcccagatcagaaccatcgccatcatcgccgagggcatccccgaggccctgaccagaaagctgatcaagaaggccgaccagaagggcgtgaccatcatcggccccgccaccgtgggcggcatcaagcccggctgcttcaagatcggcaacaccggcggcatgctggacaacatcctggccagcaagctgtacagacccggcagcgtggcctacgtgagcagaagcggcggcatgagcaacgagctgaacaacatcatcagcagaaccaccgacggcgtgtacgagggcgtggccatcggcggcgacagataccccggcagcaccttcatggaccacgtgctgagataccaggacacccccggcgtgaagatgatcgtggtgctgggcgagatcggcggcaccgaggagtacaagatctgcagaggcatcaaggagggcagactgaccaagcccatcgtgtgctggtgcatcggcacctgcgccaccatgttcagcagcgaggtgcagttcggccacgccggcgcctgcgccaaccaggccagcgagaccgccgtggccaagaaccaggccctgaaggaggccggcgtgttcgtgcccagaagcttcgacgagctgggcgagatcatccagagcgtgtacgaggacctggtggccaacggcgtgatcgtgcccgcccaggaggtgcccccccccaccgtgcccatggactacagctgggccagagagctgggcctgatcagaaagcccgccagcttcatgaccagcatctgcgacgagagaggccaggagctgatctacgccggcatgcccatcaccgaggtgttcaaggaggagatgggcatcggcggcgtgctgggcctgctgtggttccagaagagactgcccaagtacagctgccagttcatcgagatgtgcctgatggtgaccgccgaccacggccccgccgtgagcggcgcccacaacaccatcatctgcgccagagccggcaaggacctggtgagcagcctgaccagcggcctgctgaccatcggcgacagattcggcggcgccctggacgccgccgccaagatgttcagcaaggccttcgacagcggcatcatccccatggagttcgtgaacaagatgaagaaggagggcaagctgatcatgggcatcggccacagagtgaagagcatcaacaaccccgacatgagagtgcagatcctgaaggactacgtgagacagcacttccccgccacccccctgctggactacgccctggaggtggagaagatcaccaccagcaagaagcccaacctgatcctgaacgtggacggcctgatcggcgtggccttcgtggacatgctgagaaactgcggcagcttcaccagagaggaggccgacgagtacatcgacatcggcgccctgaacggcatcttcgtgctgggcagaagcatgggcttcatcggccactacctggaccagaagagactgaagcagggcctgtacagacacccctgggacgacatcagctacgtgctgcccgagcacatgagcatgtag

SEQ ID NO: 9433 - DNA, 3276 bp, Artificial Sequence
  Description of Artificial Sequence: Synthetic coding sequence
atgagcgccaaggccatcagcgagcagaccggcaaggagctgctgtacaagttcatctgcaccaccagcgccatccagaacagattcaagtacgccagagtgacccccgacaccgactgggccagactgctgcaggaccacccctggctgctgagccagaacctggtggtgaagcccgaccagctgatcaagagaagaggcaagctgggcctggtgggcgtgaacctgaccctggacggcgtgaagagctggctgaagcccagactgggccaggaggccaccgtgggcaaggccaccggcttcctgaagaacttcctgatcgagcccttcgtgccccacagccaggccgaggagttctacgtgtgcatctacgccaccagagagggcgactacgtgctgttccaccacgagggcggcgtggacgtgggcgacgtggacgccaaggcccagaagctgctggtgggcgtggacgagaagctgaaccccgaggacatcaagaagcacctgctggtgcacgcccccgaggacaagaaggagatcctggccagcttcatcagcggcctgttcaacttctacgaggacctgtacttcacctacctggagatcaaccccctggtggtgaccaaggacggcgtgtacgtgctggacctggccgccaaggtggacgccaccgccgactacatctgcaaggtgaagtggggcgacatcgagttccccccccccttcggcagagaggcctaccccgaggaggcctacatcgccgacctggacgccaagagcggcgccagcctgaagctgaccctgctgaaccccaagggcagaatctggaccatggtggccggcggcggcgccagcgtggtgtacagcgacaccatctgcgacctgggcggcgtgaacgagctggccaactacggcgagtacagcggcgcccccagcgagcagcagacctacgactacgccaagaccatcctgagcctgatgaccagagagaagcaccccgacggcaagatcctgatcatcggcggcagcatcgccaacttcaccaacgtggccgccaccttcaagggcatcgtgagagccatcagagactaccagggccccctgaaggagcacgaggtgaccatcttcgtgagaagaggcggccccaactaccaggagggcctgagagtgatgggcgaggtgggcaagaccaccggcatccccatccacgtgttcggcaccgagacccacatgaccgccatcgtgggcatggccctgggccacagacccatccccaaccagccccccaccgccgcccacaccgccaacttcctgctgaacgccagcggcagcaccagcacccccgcccccagcagaaccgccagcttcagcgagagcagagccgacgaggtggcccccgccaagaaggccaagcccgccatgccccagggcaagagcaccaccctgttcagcagacacaccaaggccatcgtgtggggcatgcagaccagagccgtgcagggcatgctggacttcgactacgtgtgcagcagagacgagcccagcgtggccgccatggtgtaccccttcaccggcgaccacaagcagaagttctactggggccacaaggagatcctgatccccgtgttcaagaacatggccgacgccatgagaaagcaccccgaggtggacgtgctgatcaacttcgccagcctgagaagcgcctacgacagcaccatggagaccatgaactacgcccagatcagaaccatcgccatcatcgccgagggcatccccgaggccctgaccagaaagctgatcaagaaggccgaccagaagggcgtgaccatcatcggccccgccaccgtgggcggcatcaagcccggctgcttcaagatcggcaacaccggcggcatgctggacaacatcctggccagcaagctgtacagacccggcagcgtggcctacgtgagcagaagcggcggcatgagcaacgagctgaacaacatcatcagcagaaccaccgacggcgtgtacgagggcgtggccatcggcggcgacagataccccggcagcaccttcatggaccacgtgctgagataccaggacacccccggcgtgaagatgatcgtggtgctgggcgagatcggcggcaccgaggagtacaagatctgcagaggcatcaaggagggcagactgaccaagcccatcgtgtgctggtgcatcggcacctgcgccaccatgttcagcagcgaggtgcagttcggccacgccggcgcctgcgccaaccaggccagcgagaccgccgtggccaagaaccaggccctgaaggaggccggcgtgttcgtgcccagaagcttcgacgagctgggcgagatcatccagagcgtgtacgaggacctggtggccaacggcgtgatcgtgcccgcccaggaggtgcccccccccaccgtgcccatggactacagctgggccagagagctgggcctgatcagaaagcccgccagcttcatgaccagcatctgcgacgagagaggccaggagctgatctacgccggcatgcccatcaccgaggtgttcaaggaggagatgggcatcggcggcgtgctgggcctgctgtggttccagaagagactgcccaagtacagctgccagttcatcgagatgtgcctgatggtgaccgccgaccacggccccgccgtgagcggcgcccacaacaccatcatctgcgccagagccggcaaggacctggtgagcagcctgaccagcggcctgctgaccatcggcgacagattcggcggcgccctggacgccgccgccaagatgttcagcaaggccttcgacagcggcatcatccccatggagttcgtgaacaagatgaagaaggagggcaagctgatcatgggcatcggccacagagtgaagagcatcaacaaccccgacatgagagtgcagatcctgaaggactacgtgagacagcacttccccgccacccccctgctggactacgccctggaggtggagaagatcaccaccagcaagaagcccaacctgatcctgaacgtggacggcctgatcggcgtggccttcgtggacatgctgagaaactgcggcagcttcaccagagaggaggccgacgagtacatcgacatcggcgccctgaacggcatcttcgtgctgggcagaagcatgggcttcatcggccactacctggaccagaagagactgaagcagggcctgtacagacacccctgggacgacatcagctacgtgctgcccgagcacatgagcatgtag

SEQ ID NO: 9434 - DNA, 3276 bp, Artificial Sequence; identical to SEQ ID NO: 9433
  Description of Artificial Sequence: Synthetic coding sequence

SEQ ID NO: 9435 - DNA, 3468 bp, Artificial Sequence
  Description of Artificial Sequence: Synthetic coding sequence
atgggcgccggcaagagccccgccggccccggccagaagcccgaccccggcaagctgcccgccgccggcgtgctgagaatcctgagaggcagcagcggcctgtggaagaagagaagagccagaaccagcgccgagaccggcagagccggcctgagcgccgccatgagcgccaaggccatcagcgagcagaccggcaaggagctgctgtacaagttcatctgcaccaccagcgccatccagaacagattcaagtacgccagagtgacccccgacaccgactgggccagactgctgcaggaccacccctggctgctgagccagaacctggtggtgaagcccgaccagctgatcaagagaagaggcaagctgggcctggtgggcgtgaacctgaccctggacggcgtgaagagctggctgaagcccagactgggccaggaggccaccgtgggcaaggccaccggcttcctgaagaacttcctgatcgagcccttcgtgccccacagccaggccgaggagttctacgtgtgcatctacgccaccagagagggcgactacgtgctgttccaccacgagggcggcgtggacgtgggcgacgtggacgccaaggcccagaagctgctggtgggcgtggacgagaagctgaaccccgaggacatcaagaagcacctgctggtgcacgcccccgaggacaagaaggagatcctggccagcttcatcagcggcctgttcaacttctacgaggacctgtacttcacctacctggagatcaaccccctggtggtgaccaaggacggcgtgtacgtgctggacctggccgccaaggtggacgccaccgccgactacatctgcaaggtgaagtggggcgacatcgagttccccccccccttcggcagagaggcctaccccgaggaggcctacatcgccgacctggacgccaagagcggcgccagcctgaagctgaccctgctgaaccccaagggcagaatctggaccatggtggccggcggcggcgccagcgtggtgtacagcgacaccatctgcgacctgggcggcgtgaacgagctggccaactacggcgagtacagcggcgcccccagcgagcagcagacctacgactacgccaagaccatcctgagcctgatgaccagagagaagcaccccgacggcaagatcctgatcatcggcggcagcatcgccaacttcaccaacgtggccgccaccttcaagggcatcgtgagagccatcagagactaccagggccccctgaaggagcacgaggtgaccatcttcgtgagaagaggcggccccaactaccaggagggcctgagagtgatgggcgaggtgggcaagaccaccggcatccccatccacgtgttcggcaccgagacccacatgaccgccatcgtgggcatggccctgggccacagacccatccccaaccagccccccaccgccgcccacaccgccaacttcctgctgaacgccagcggcagcaccagcacccccgcccccagcagaaccgccagcttcagcgagagcagagccgacgaggtggcccccgccaagaaggccaagcccgccatgccccaggacagcgtgcccagccccagaagcctgcagggcaagagcaccaccctgttcagcagacacaccaaggccatcgtgtggggcatgcagaccagagccgtgcagggcatgctggacttcgactacgtgtgcagcagagacgagcccagcgtggccgccatggtgtaccccttcaccggcgaccacaagcagaagttctactggggccacaaggagatcctgatccccgtgttcaagaacatggccgacgccatgagaaagcaccccgaggtggacgtgctgatcaacttcgccagcctgagaagcgcctacgacagcaccatggagaccatgaactacgcccagatcagaaccatcgccatcatcgccgagggcatccccgaggccctgaccagaaagctgatcaagaaggccgaccagaagggcgtgaccatcatcggccccgccaccgtgggcggcatcaagcccggctgcttcaagatcggcaacaccggcggcatgctggacaacatcctggccagcaagctgtacagacccggcagcgtggcctacgtgagcagaagcggcggcatgagcaacgagctgaacaacatcatcagcagaaccaccgacggcgtgtacgagggcgtggccatcggcggcgacagataccccggcagcaccttcatggaccacgtgctgagataccaggacacccccggcgtgaagatgatcgtggtgctgggcgagatcggcggcaccgaggagtacaagatctgcagaggcatcaaggagggcagactgaccaagcccatcgtgtgctggtgcatcggcacctgcgccaccatgttcagcagcgaggtgcagttcggccacgccggcgcctgcgccaaccaggccagcgagaccgccgtggccaagaaccaggccctgaaggaggccggcgtgttcgtgcccagaagcttcgacgagctgggcgagatcatccagagcgtgtacgaggacctggtggccaacggcgtgatcgtgcccgcccaggaggtgcccccccccaccgtgcccatggactacagctgggccagagagctgggcctgatcagaaagcccgccagcttcatgaccagcatctgcgacgagagaggccaggagctgatctacgccggcatgcccatcaccgaggtgttcaaggaggagatgggcatcggcggcgtgctgggcctgctgtggttccagaagagactgcccaagtacagctgccagttcatcgagatgtgcctgatggtgaccgccgaccacggccccgccgtgagcggcgcccacaacaccatcatctgcgccagagccggcaaggacctggtgagcagcctgaccagcggcctgctgaccatcggcgacagattcggcggcgccctggacgccgccgccaagatgttcagcaaggccttcgacagcggcatcatccccatggagttcgtgaacaagatgaagaaggagggcaagctgatcatgggcatcggccacagagtgaagagcatcaacaaccccgacatgagagtgcagatcctgaaggactacgtgagacagcacttccccgccacccccctgctggactacgccctggaggtggagaagatcaccaccagcaagaagcccaacctgatcctgaacgtggacggcctgatcggcgtggccttcgtggacatgctgagaaactgcggcagcttcaccagagaggaggccgacgagtacatcgacatcggcgccctgaacggcatcttcgtgctgggcagaagcatgggcttcatcggccactacctggaccagaagagactgaagcagggcctgtacagacacccctgggacgacatcagctacgtgctgcccgagcacatgagcatgtag

SEQ ID NO: 9436 - DNA, 2493 bp, Artificial Sequence
  Description of Artificial Sequence: Synthetic coding sequence
atgagcgccaaggccatcagcgagcagaccggcaaggagctgctgtacaagttcatctgcaccaccagcgccatccagaacagattcaagtacgccagagtgacccccgacaccgactgggccagactgctgcaggaccacccctggctgctgagccagaacctggtggtgaagcccgaccagctgatcaagagaagaggcaagctgggcctggtgggcgtgaacctgaccctggacggcgtgaagagctggctgaagcccagactgggccaggaggccaccggcatcgtgagagccatcagagactaccagggccccctgaaggagcacgaggtgaccatcttcgtgagaagaggcggccccaactaccaggagggcctgagagtgatgggcgaggtgggcaagaccaccggcatccccatccacgtgttcggcaccgagacccacatgaccgccatcgtgggcatggccctgggccacagacccatccccaaccagccccccaccgccgcccacaccgccaacttcctgctgaacgccagcggcagcaccagcacccccgcccccagcagaaccgccagcttcagcgagagcagagccgacgaggtggcccccgccaagaaggccaagcccgccatgccccagggcaagagcaccaccctgttcagcagacacaccaaggccatcgtgtggggcatgcagaccagagccgtgcagggcatgctggacttcgactacgtgtgcagcagagacgagcccagcgtggccgccatggtgtaccccttcaccggcgaccacaagcagaagttctactggggccacaaggagatcctgatccccgtgttcaagaacatggccgacgccatgagaaagcaccccgaggtggacgtgctgatcaacttcgccagcctgagaagcgcctacgacagcaccatggagaccatgaactacgcccagatcagaaccatcgccatcatcgccgagggcatccccgaggccctgaccagaaagctgatcaagaaggccgaccagaagggcgtgaccatcatcggccccgccaccgtgggcggcatcaagcccggctgcttcaagatcggcaacaccggcggcatgctggacaacatcctggccagcaagctgtacagacccggcagcgtggcctacgtgagcagaagcggcggcatgagcaacgagctgaacaacatcatcagcagaaccaccgacggcgtgtacgagggcgtggccatcggcggcgacagataccccggcagcaccttcatggaccacgtgctgagataccaggacacccccggcgtgaagatgatcgtggtgctgggcgagatcggcggcaccgaggagtacaagatctgcagaggcatcaaggagggcagactgaccaagcccatcgtgtgctggtgcatcggcacctgcgccaccatgttcagcagcgaggtgcagttcggccacgccggcgcctgcgccaaccaggccagcgagaccgccgtggccaagaaccaggccctgaaggaggccggcgtgttcgtgcccagaagcttcgacgagctgggcgagatcatccagagcgtgtacgaggacctggtggccaacggcgtgatcgtgcccgcccaggaggtgcccccccccaccgtgcccatggactacagctgggccagagagctgggcctgatcagaaagcccgccagcttcatgaccagcatctgcgacgagagaggccaggagctgatctacgccggcatgcccatcaccgaggtgttcaaggaggagatgggcatcggcggcgtgctgggcctgctgtggttccagaagagactgcccaagtacagctgccagttcatcgagatgtgcctgatggtgaccgccgaccacggccccgccgtgagcggcgcccacaacaccatcatctgcgccagagccggcaaggacctggtgagcagcctgaccagcggcctgctgaccatcggcgacagattcggcggcgccctggacgccgccgccaagatgttcagcaaggccttcgacagcggcatcatccccatggagttcgtgaacaagatgaagaaggagggcaagctgatcatgggcatcggccacagagtgaagagcatcaacaaccccgacatgagagtgcagatcctgaaggactacgtgagacagcacttccccgccacccccctgctggactacgccctggaggtggagaagatcaccaccagcaagaagcccaacctgatcctgaacgtggacggcctgatcggcgtggccttcgtggacatgctgagaaactgcggcagcttcaccagagaggaggccgacgagtacatcgacatcggcgccctgaacggcatcttcgtgctgggcagaagcatgggcttcatcggccactacctggaccagaagagactgaagcagggcctgtacagacacccctgggacgacatcagctacgtgctgcccgagcacatgagcatgtag

SEQ ID NO: 9437 - DNA, 1512 bp, Artificial Sequence
  Description of Artificial Sequence: Synthetic coding sequence
atgagcagcatcctggaggagagaatcctgggcgccgacaccagcgtggacctggaggagaccggcagagtgctgagcatcggcgacggcatcgccagagtgcacggcctgagaaacgtgcaggccgaggagatggtggagttcagcagcggcctgaagggcatgagcctgaacctggagcccgacaacgtgggcgtggtggtgttcggcaacgacaagctgatcaaggagggcgacatcgtgaagagaaccggcgccatcgtggacgtgcccgtgggcgaggagctgctgggcagagtggtggacgccctgggcaacgccatcgacggcaagggccccatcggcagcaagaccagaagaagagtgggcctgaaggcccccggcatcatccccagaatcagcgtgagagagcccatgcagaccggcatcaaggccgtggacagcctggtgcccatcggcagaggccagagagagctgatcatcggcgacagacagaccggcaagaccagcatcgccatcgacaccatcatcaaccagaagagattcaacgacggcagcgacgagaagaagaagctgtactgcatctacgtggccatcggccagaagagaagcaccgtggcccagctggtgaagagactgaccgacgccgacgccatgaagtacaccatcgtggtgagcgccaccgccagcgacgccgcccccctgcagtacctggccccctacagcggctgcagcatgggcgagtacttcagagacaacggcaagcacgccctgatcatctacgacgacctgagcaagcaggccgtggcctacagacagatgagcctgctgctgagaagaccccccggcagagaggcctaccccggcgacgtgttctacctgcacagcagactgctggagagagccgccaagatgaacgacgccttcggcggcggcagcctgaccgccctgcccgtgatcgagacccaggccggcgacgtgagcgcctacatccccaccaacgtgatcagcatcaccgacggccagatcttcctggagaccgagctgttctacaagggcatcagacccgccatcaacgtgggcctgagcgtgagcagagtgggcagcgccgcccagaccagagccatgaagcaggtggccggcaccatgaagctggagctggcccagtacagagaggtggccgccttcgcccagttcggcagcgacctggacgccgccacccagcagctgctgagcagaggcgtgagactgaccgagctgctgaagcagggccagtacagccccatggccatcgaggagcaggtggccgtgatctacgccggcgtgagaggctacctggacaagctggagcccagcaagatcaccaagttcgagaacgccttcctgagccacgtggtgagccagcaccaggccctgctgggcaccatcagagccgacggcaagatcagcgagcagagcgacgccaagctgaaggagatcgtgaccaacttcctggccggcttcgaggcctag

SEQ ID NO: 9438 - DNA, 177 bp, Artificial Sequence
  Description of Artificial Sequence: Synthetic coding sequence
atgctgagcgtgagagtggccgccgccgtggtgagagccctgcccagaagagccggcctggtgagcagaaacgccctgggcagcagcttcatcgccgccagaaacttccacgccagcaacacccacctgcagaagaccggcaagctgctgttcctgagcctgagaagaacctactag

SEQ ID NO: 9439 - DNA, 1596 bp, Artificial Sequence
  Description of Artificial Sequence: Synthetic coding sequence
atgctgagcgtgagagtggccgccgccgtggtgagagccctgcccagaagagccggcctggtgagcagaaacgccctgggcagcagcttcatcgccgccagaaacttccacgccagcaacacccacctgcagaagaccggcaccgccgagatgagcagcatcctggaggagagaatcctgggcgccgacaccagcgtggacctggaggagaccggcagagtgctgagcatcggcgacggcatcgccagagtgcacggcctgagaaacgtgcaggccgaggagatggtggagttcagcagcggcctgaagggcatgagcctgaacctggagcccgacaacgtgggcgtggtggtgttcggcaacgacaagctgatcaaggagggcgacatcgtgaagagaaccggcgccatcgtggacggccccatcggcagcaagaccagaagaagagtgggcctgaaggcccccggcatcatccccagaatcagcgtgagagagcccatgcagaccggcatcaaggccgtggacagcctggtgcccatcggcagaggccagagagagctgatcatcggcgacagacagaccggcaagaccagcatcgccatcgacaccatcatcaaccagaagagattcaacgacggcagcgacgagaagaagaagctgtactgcatctacgtggccatcggccagaagagaagcaccgtggcccagctggtgaagagactgaccgacgccgacgccatgaagtacaccatcgtggtgagcgccaccgccagcgacgccgcccccctgcagtacctggccccctacagcggctgcagcatgggcgagtacttcagagacaacggcaagcacgccctgatcatctacgacgacctgagcaagcaggccgtggcctacagacagatgagcctgctgctgagaagaccccccggcagagaggcctaccccggcgacgtgttctacctgcacagcagactgctggagagagccgccaagatgaacgacgccttcggcggcggcagcctgaccgccctgcccgtgatcgagacccaggccggcgacgtgagcgcctacatccccaccaacgtgatcagcatcaccgacggccagatcttcctggagaccgagctgttctacaagggcatcagacccgccatcaacgtgggcctgagcgtgagcagagtgggcagcgccgcccagaccagagccatgaagcaggtggccggcaccatgaagctggagctggcccagtacagagaggtggccgccttcgcccagttcggcagcgacctggacgccgccacccagcagctgctgagcagaggcgtgagactgaccgagctgctgaagcagggccagtacagccccatggccatcgaggagcaggtggccgtgatctacgccggcgtgagaggctacctggacaagctggagcccagcaagatcaccaagttcgagaacgccttcctgagccacgtggtgagccagcaccaggccctgctgggcaccatcagagccgacggcaagatcagcgagcagagcgacgccaagctgaaggagatcgtgaccaacttcctggccggcttcgaggcctag

SEQ ID NO: 9440 - DNA, 1662 bp, Artificial Sequence
  Description of Artificial Sequence: Synthetic coding sequence
atgctgagcgtgagagtggccgccgccgtggtgagagccctgcccagaagagccggcctggtgagcagaaacgccctgggcagcagcttcatcgccgccagaaacttccacgccagcaacacccacctgcagaagaccggcaccgccgagatgagcagcatcctggaggagagaatcctgggcgccgacaccagcgtggacctggaggagaccggcagagtgctgagcatcggcgacggcatcgccagagtgcacggcctgagaaacgtgcaggccgaggagatggtggagttcagcagcggcctgaagggcatgagcctgaacctggagcccgacaacgtgggcgtggtggtgttcggcaacgacaagctgatcaaggagggcgacatcgtgaagagaaccggcgccatcgtggacgtgcccgtgggcgaggagctgctgggcagagtggtggacgccctgggcaacgccatcgacggcaagggccccatcggcagcaagaccagaagaagagtgggcctgaaggcccccggcatcatccccagaatcagcgtgagagagcccatgcagaccggcatcaaggccgtggacagcctggtgcccatcggcagaggccagagagagctgatcatcggcgacagacagaccggcaagaccagcatcgccatcgacaccatcatcaaccagaagagattcaacgacggcagcgacgagaagaagaagctgtactgcatctacgtggccatcggccagaagagaagcaccgtggcccagctggtgaagagactgaccgacgccgacgccatgaagtacaccatcgtggtgagcgccaccgccagcgacgccgcccccctgcagtacctggccccctacagcggctgcagcatgggcgagtacttcagagacaacggcaagcacgccctgatcatctacgacgacctgagcaagcaggccgtggcctacagacagatgagcctgctgctgagaagaccccccggcagagaggcctaccccggcgacgtgttctacctgcacagcagactgctggagagagccgccaagatgaacgacgccttcggcggcggcagcctgaccgccctgcccgtgatcgagacccaggccggcgacgtgagcgcctacatccccaccaacgtgatcagcatcaccgacggccagatcttcctggagaccgagctgttctacaagggcatcagacccgccatcaacgtgggcctgagcgtgagcagagtgggcagcgccgcccagaccagagccatgaagcaggtggccggcaccatgaagctggagctggcccagtacagagaggtggccgccttcgcccagttcggcagcgacctggacgccgccacccagcagctgctgagcagaggcgtgagactgaccgagctgctgaagcagggccagtacagccccatggccatcgaggagcaggtggccgtgatctacgccggcgtgagaggctacctggacaagctggagcccagcaagatcaccaagttcgagaacgccttcctgagccacgtggtgagccagcaccaggccctgctgggcaccatcagagccgacggcaagatcagcgagcagagcgacgccaagctgaaggagatcgtgaccaacttcctggccggcttcgaggcctag

SEQ ID NO: 9441 - DNA, 1662 bp, Artificial Sequence; identical to SEQ ID NO: 9440
  Description of Artificial Sequence: Synthetic coding sequence

SEQ ID NO: 9442 - DNA, 1512 bp, Artificial Sequence; identical to SEQ ID NO: 9437
  Description of Artificial Sequence: Synthetic coding sequence

SEQ ID NO: 9443 - DNA, 3843 bp, Artificial Sequence
  Description of Artificial Sequence: Synthetic coding sequence
atggacctggagggcgacagaaacggcggcgccaagaagaagaacttcttcaagctgaacaacaagagcgagaaggacaagaaggagaagaagcccaccgtgagcgtgttcagcatgttcagatacagcaactggctggacaagctgtacatggtggtgggcaccctggccgccatcatccacggcgccggcctgcccctgatgatgctggtgttcggcgagatgaccgacatcttcgccaacgccggcaacctggaggacctgatgagcaacatcaccaacagaagcgacatcaacgacaccggcttcttcatgaacctggaggaggacatgaccagatacgcctactactacagcggcatcggcgccggcgtgctggtggccgcctacatccaggtgagcttctggtgcctggccgccggcagacagatccacaagatcagaaagcagttcttccacgccatcatgagacaggagatcggctggttcgacgtgcacgacgtgggcgagctgaacaccagactgaccgacgacgtgagcaagatcaacgagggcatcggcgacaagatcggcatgttcttccagagcatggccaccttcttcaccggcttcatcgtgggcttcaccagaggctggaagctgaccctggtgatcctggccatcagccccgtgctgggcctgagcgccgccgtgtgggccaagatcctgagcagcttcaccgacaaggagctgctggcctacgccaaggccggcgccgtggccgaggaggtgctggccgccatcagaaccgtgatcgccttcggcggccagaagaaggagctggagagatacaacaagaacctggaggaggccaagagaatcggcatcaagaaggccatcaccgccaacatcagcatcggcgccgccttcctgctgatctacgccagctacgccctggccttctggtacggcaccaccctggtgctgagcggcgagtacagcatcggccaggtgctgaccgtgttcttcagcgtgctgatcggcgccttcagcgtgggccaggccagccccagcatcgaggccttcgccaacgccagaggcgccgcctacgagatcttcaagatcatcgacaacaagcccagcatcgacagctacagcaagagcggccacaagcccgacaacatcaagggcaacctggagttcagaaacgtgcacttcagctaccccagcagaaaggaggtgaagatcctgaagggcctgaacctgaaggtgcagagcggccagaccgtggccctggtgggcaacagcggctgcggcaagagcaccaccgtgcagctgatgcagagactgtacgaccccaccgagggcatggtgagcgtggacggccaggacatcagaaccatcaacgtgagattcctgagagagatcatcggcgtggtgagccaggagcccgtgctgttcgccaccaccatcgccgagaacatcagatacggcagagagaacgtgaccatggacgagatcgagaaggccgtgaaggaggccaacgcctacgacttcatcatgaagctgccccacaagttcgacaccctggtgggcgagagaggcgcccagctgagcggcggccagaagcagagaatcgccatcgccagagccctggtgagaaaccccaagatcctgctgctggacgaggccaccagcgccctggacaccgagagcgaggccgtggtgcaggtggccctggacaaggccagaaagggcagaaccaccatcgtgatcgcccacagactgagcaccgtgagaaacgccgacgtgatcgccggcttcgacgacggcgtgatcgtggagaagggcaaccacgacgagctgatgaaggagaagggcatctacttcaagctggtgaccatgcagaccgccggcaacgaggtggagctggagaacgccgccgacgagagcaagagcgagatcgacgccctggagatgagcagcaacgacagcagaagcagcctgatcagaaagagaagcaccagaagaagcgtgagaggcagccaggcccaggacagaaagctgagcaccaaggaggccctggacgagagcatcccccccgtgagcttctggagaatcatgaagctgaacctgaccgagtggccctacttcgtggtgggcgtgttctgcgccatcatcaacggcggcctgcagcccgccttcgccatcatcttcagcaagatcatcggcgtgttcaccagaatcgacgaccccgagaccaagagacagaacagcaacctgttcagcctgctgttcctggccctgggcatcatcagcttcatcaccttcttcctgcagggcttcaccttcggcaaggccggcgagatcctgaccaagagactgagatacatggtgttcagaagcatgctgagacaggacgtgagctggttcgacgaccccaagaacaccaccggcgccctgaccaccagactggccaacgacgccgcccaggtgaagggcgccatcggcagcagactggccgtgatcacccagaacatcgccaacctgggcaccggcatcatcatcagcttcatctacggctggcagctgaccctgctgctgctggccatcgtgcccatcatcgccatcgccggcgtggtggagatgaagatgctgagcggccaggccctgaaggacaagaaggagctggagggcagcggcaagatcgccaccgaggccatcgagaacttcagaaccgtggtgagcctgacccaggagcagaagttcgagcacatgtacgcccagagcctgcaggtgccctacagaaacagcctgagaaaggcccacatcttcggcatcaccttcagcttcacccaggccatgatgtacttcagctacgccggctgcttcagattcggcgcctacctggtggcccacaagctgatgagcttcgaggacgtgctgctggtgttcagcgccgtggtgttcggcgccatggccgtgggccaggtgagcagcttcgcccccgactacgccaaggccaagatcagcgccgcccacatcatcatgatcatcgagaagacccccctgatcgacagctacagcaccgagggcctgatgcccaacaccctggagggcaacgtgaccttcggcgaggtggtgttcaactaccccaccagacccgacatccccgtgctgcagggcctgagcctggaggtgaagaagggccagaccctggccctggtgggcagcagcggctgcggcaagagcaccgtggtgcagctgctggagagattctacgaccccctggccggcaaggtgctgctggacggcaaggagatcaagagactgaacgtgcagtggctgagagcccacctgggcatcgtgagccaggagcccatcctgttcgactgcagcatcgccgagaacatcgcctacggcgacaacagcagagtggtgagccaggaggagatcgtgagagccgccaaggaggccaacatccacgccttcatcgagagcctgcccaacaagtacagcaccaaggtgggcgacaagggcacccagctgagcggcggccagaagcagagaatcgccatcgccagagccctggtgagacagccccacatcctgctgctggacgaggccaccagcgccctggacaccgagagcgagaaggtggtgcaggaggccctggacaaggccagagagggcagaacctgcatcgtgatcgcccacagactgagcaccatccagaacgccgacctgatcgtggtgttccagaacggcagagtgaaggagcacggcacccaccagcagctgctggcccagaagggcatctacttcagcatggtgagcgtgcaggccggcaccaagagacagtag

SEQ ID NO: 9444 - DNA, 69 bp, Artificial Sequence
  Description of Artificial Sequence: Synthetic coding sequence
atggacctggagggcgacagaaacggcggcgccaagaagaagaacttcttcaagctgaacaacaagtag

SEQ ID NO: 9445 - DNA, 147 bp, Artificial Sequence
  Description of Artificial Sequence: Synthetic coding sequence
atggacctggagggcgacagaaacggcggcgccaagaagaagaacttcttcaagctgaacaacaagagcgagaaggacaagaaggagaagaagcccaccgtgagcgtgttcagcatgttcagatacagcaactggctggacaagtag

SEQ ID NO: 9446 - DNA, 3186 bp, Artificial Sequence
  Description of Artificial Sequence: Synthetic coding sequence
gccctgagccccgtgatgggcgtgagcgccggctactggcccaagatcctgagcagcttcaccgacaaggagctgctggcctacgccaaggccggcgccgtggccgaggaggtgctggccgccatcagaaccgtgatcgccttcggcggccagaagaaggagctggagagatacaacaagaacctggaggaggccaagagaatcggcatcaagaaggccatcaccgccaacatcagcatcggcgccgccttcctgctgatctacgccagctacgccctggccttctggtacggcaccaccctggtgctgagcggcgagtacagcatcggccaggtgctgaccgtgttcttcagcgtgctgatcggcgccttcagcgtgggccaggccagccccagcatcgaggccttcgccaacgccagaggcgccgcctacgagatcttcaagatcatcgacaacaagcccagcatcgacagctacagcaagagcggccacaagcccgacaacatcaagggcaacctggagttcagaaacgtgcacttcagctaccccagcagaaaggaggtgaagatcctgaagggcctgaacctgaaggtgcagagcggccagaccgtggccctggtgggcaacagcggctgcggcaagagcaccaccgtgcagctgatgcagagactgtacgaccccaccgagggcatggtgagcgtggacggccaggacatcagaaccatcaacgtgagattcctgagagagatcatcggcgtggtgagccaggagcccgtgctgttcgccaccaccatcgccgagaacatcagatacggcagagagaacgtgaccatggacgagatcgagaaggccgtgaaggaggccaacgcctacgacttcatcatgaagctgccccacaagttcgacaccctggtgggcgagagaggcgcccagctgagcggcggccagaagcagagaatcgccatcgccagagccctggtgagaaaccccaagatcctgctgctggacgaggccaccagcgccctggacaccgagagcgaggccgtggtgcaggtggccctggacaaggccagaaagggcagaaccaccatcgtgatcgcccacagactgagcaccgtgagaaacgccgacgtgatcgccggcttcgacgacggcgtgatcgtggagaagggcaaccacgacgagctgatgaaggagaagggcatctacttcaagctggtgaccatgcagaccgccggcaacgaggtggagctggagaacgccgccgacgagagcaagagcgagatcgacgccctggagatgagcagcaacgacagcagaagcagcctgatcagaaagagaagcaccagaagaagcgtgagaggcagccaggcccaggacagaaagctgagcaccaaggaggccctggacgagagcatcccccccgtgagcttctggagaatcatgaagctgaacctgaccgagtggccctacttcgtggtgggcgtgttctgcgccatcatcaacggcggcctgcagcccgccttcgccatcatcttcagcaagatcatcggcgtgttcaccagaatcgacgaccccgagaccaagagacagaacagcaacctgttcagcctgctgttcctggccctgggcatcatcagcttcatcaccttcttcctgcagggcttcaccttcggcaaggccggcgagatcctgaccaagagactgagatacatggtgttcagaagcatgctgagacaggacgtgagctggttcgacgaccccaagaacaccaccggcgccctgaccaccagactggccaacgacgccgcccaggtgaagggcgccatcggcagcagactggccgtgatcacccagaacatcgccaacctgggcaccggcatcatcatcagcttcatctacggctggcagctgaccctgctgctgctggccatcgtgcccatcatcgccatcgccggcgtggtggagatgaagatgctgagcggccaggccctgaaggacaagaaggagctggagggcagcggcaagatcgccaccgaggccatcgagaacttcagaaccgtggtgagcctgacccaggagcagaagttcgagcacatgtacgcccagagcctgcaggtgccctacagaaacagcctgagaaaggcccacatcttcggcatcaccttcagcttcacccaggccatgatgtacttcagctacgccggctgcttcagattcggcgcctacctggtggcccacaagctgatgagcttcgaggacgtgctgctggtgttcagcgccgtggtgttcggcgccatggccgtgggccaggtgagcagcttcgcccccgactacgccaaggccaagatcagcgccgcccacatcatcatgatcatcgagaagacccccctgatcgacagctacagcaccgagggcctgatgcccaacaccctggagggcaacgtgaccttcggcgaggtggtgttcaactaccccaccagacccgacatccccgtgctgcagggcctgagcctggaggtgaagaagggccagaccctggccctggtgggcagcagcggctgcggcaagagcaccgtggtgcagctgctggagagattctacgaccccctggccggcaaggtgctgctggacggcaaggagatcaagagactgaacgtgcagtggctgagagcccacctgggcatcgtgagccaggagcccatcctgttcgactgcagcatcgccgagaacatcgcctacggcgacaacagcagagtggtgagccaggaggagatcgtgagagccgccaaggaggccaacatccacgccttcatcgagagcctgcccaacaagtacagcaccaaggtgggcgacaagggcacccagctgagcggcggccagaagcagagaatcgccatcgccagagccctggtgagacagccccacatcctgctgctggacgaggccaccagcgccctggacaccgagagcgagaaggtggtgcaggaggccctggacaaggccagagagggcagaacctgcatcgtgatcgcccacagactgagcaccatccagaacgccgacctgatcgtggtgttccagaacggcagagtgaaggagcacggcacccaccagcagctgctggcccagaagggcatctacttcagcatggtgagcgtgcaggccggcaccaagagacagtag

SEQ ID NO: 9447 - DNA, 3651 bp, Artificial Sequence
  Description of Artificial Sequence: Synthetic coding sequence
atggacctggagggcgacagaaacggcggcgccaagaagaagaacttcttcaagctgaacaacaagagcgagaaggacaagaaggagaagaagcccaccgtgagcgtgttcagcatgttcagatacagcaactggctggacaagctgtacatggtggtgggcaccctggccgccatcatccacggcgccggcctgcccctgatgatgctggtgttcggcgagatgaccgacatcttcgccaacgccggcaacctggaggacctgatgagcaacatcaccaacagaagcgacatcaacgacaccggcttcttcatgaacctggaggaggacatgaccagcgacgtgagcaagatcaacgagggcatcggcgacaagatcggcatgttcttccagagcatggccaccttcttcaccggcttcatcgtgggcttcaccagaggctggaagctgaccctggtgatcctggccatcagccccgtgctgggcctgagcgccgccgtgtgggccaagatcctgagcagcttcaccgacaaggagctgctggcctacgccaaggccggcgccgtggccgaggaggtgctggccgccatcagaaccgtgatcgccttcggcggccagaagaaggagctggagagatacaacaagaacctggaggaggccaagagaatcggcatcaagaaggccatcaccgccaacatcagcatcggcgccgccttcctgctgatctacgccagctacgccctggccttctggtacggcaccaccctggtgctgagcggcgagtacagcatcggccaggtgctgaccgtgttcttcagcgtgctgatcggcgccttcagcgtgggccaggccagccccagcatcgaggccttcgccaacgccagaggcgccgcctacgagatcttcaagatcatcgacaacaagcccagcatcgacagctacagcaagagcggccacaagcccgacaacatcaagggcaacctggagttcagaaacgtgcacttcagctaccccagcagaaaggaggtgaagatcctgaagggcctgaacctgaaggtgcagagcggccagaccgtggccctggtgggcaacagcggctgcggcaagagcaccaccgtgcagctgatgcagagactgtacgaccccaccgagggcatggtgagcgtggacggccaggacatcagaaccatcaacgtgagattcctgagagagatcatcggcgtggtgagccaggagcccgtgctgttcgccaccaccatcgccgagaacatcagatacggcagagagaacgtgaccatggacgagatcgagaaggccgtgaaggaggccaacgcctacgacttcatcatgaagctgccccacaagttcgacaccctggtgggcgagagaggcgcccagctgagcggcggccagaagcagagaatcgccatcgccagagccctggtgagaaaccccaagatcctgctgctggacgaggccaccagcgccctggacaccgagagcgaggccgtggtgcaggtggccctggacaaggccagaaagggcagaaccaccatcgtgatcgcccacagactgagcaccgtgagaaacgccgacgtgatcgccggcttcgacgacggcgtgatcgtggagaagggcaaccacgacgagctgatgaaggagaagggcatctacttcaagctggtgaccatgcagaccgccggcaacgaggtggagctggagaacgccgccgacgagagcaagagcgagatcgacgccctggagatgagcagcaacgacagcagaagcagcctgatcagaaagagaagcaccagaagaagcgtgagaggcagccaggcccaggacagaaagctgagcaccaaggaggccctggacgagagcatcccccccgtgagcttctggagaatcatgaagctgaacctgaccgagtggccctacttcgtggtgggcgtgttctgcgccatcatcaacggcggcctgcagcccgccttcgccatcatcttcagcaagatcatcggcgtgttcaccagaatcgacgaccccgagaccaagagacagaacagcaacctgttcagcctgctgttcctggccctgggcatcatcagcttcatcaccttcttcctgcagggcttcaccttcggcaaggccggcgagatcctgaccaagagactgagatacatggtgttcagaagcatgctgagacaggacgtgagctggttcgacgaccccaagaacaccaccggcgccctgaccaccagactggccaacgacgccgcccaggtgaagggcgccatcggcagcagactggccgtgatcacccagaacatcgccaacctgggcaccggcatcatcatcagcttcatctacggctggcagctgaccctgctgctgctggccatcgtgcccatcatcgccatcgccggcgtggtggagatgaagatgctgagcggccaggccctgaaggacaagaaggagctggagggcagcggcaagatcgccaccgaggccatcgagaacttcagaaccgtggtgagcctgacccaggagcagaagttcgagcacatgtacgcccagagcctgcaggtgccctacagaaacagcctgagaaaggcccacatcttcggcatcaccttcagcttcacccaggccatgatgtacttcagctacgccggctgcttcagattcggcgcctacctggtggcccacaagctgatgagcttcgaggacgtgctgctggtgttcagcgccgtggtgttcggcgccatggccgtgggccaggtgagcagcttcgcccccgactacgccaaggccaagatcagcgccgcccacatcatcatgatcatcgagaagacccccctgatcgacagctacagcaccgagggcctgatgcccaacaccctggagggcaacgtgaccttcggcgaggtggtgttcaactaccccaccagacccgacatccccgtgctgcagggcctgagcctggaggtgaagaagggccagaccctggccctggtgggcagcagcggctgcggcaagagcaccgtggtgcagctgctggagagattctacgaccccctggccggcaaggtgctgctggacggcaaggagatcaagagactgaacgtgcagtggctgagagcccacctgggcatcgtgagccaggagcccatcctgttcgactgcagcatcgccgagaacatcgcctacggcgacaacagcagagtggtgagccaggaggagatcgtgagagccgccaaggaggccaacatccacgccttcatcgagagcctgcccaacaagtacagcaccaaggtgggcgacaagggcacccagctgagcggcggccagaagcagagaatcgccatcgccagagccctggtgagacagccccacatcctgctgctggacgaggccaccagcgccctggacaccgagagcgagaaggtggtgcaggaggccctggacaaggccagagagggcagaacctgcatcgtgatcgcccacagactgagcaccatccagaacgccgacctgatcgtggtgttccagaacggcagagtgaaggagcacggcacccaccagcagctgctggcccagaagggcatctacttcagcatggtgagcgtgcaggccggcaccaagagacagtag

SEQ ID NO: 9448 - DNA, 4401 bp, Artificial Sequence
  Description of Artificial Sequence: Synthetic coding sequence
atggccctgagaggcttctgcagcgccgacggcagcgaccccctgtgggactggaacgtgacctggaacaccagcaaccccgacttcaccaagtgcttccagaacaccgtgctggtgtgggtgccctgcttctacctgtgggcctgcttccccttctacttcctgtacctgagcagacacgacagaggctacatccagatgacccccctgaacaagaccaagaccgccctgggcttcctgctgtggatcgtgtgctgggccgacctgttctacagcttctgggagagaagcagaggcatcttcctggcccccgtgttcctggtgagccccaccctgctgggcatcaccatgctgctggccaccttcctgatccagctggagagaagaaagggcgtgcagagcagcggcatcatgctgaccttctggctggtggccctggtgtgcgccctggccatcctgagaagcaagatcatgaccgccctgaaggaggacgcccaggtggacctgttcagagacatcaccttctacgtgtacttcagcctgctgctgatccagctggtgctgagctgcttcagcgacagaagccccctgttcagcgagaccatccacgaccccaacccctgccccgagagcagcgccagcttcctgagcagaatcaccttctggtggatcaccggcctgatcgtgagaggctacagacagcccctggagggcagcgacctgtggagcctgaacaaggaggacaccagcgagcaggtggtgcccgtgctggtgaagaactggaagaaggagtgcgccaagaccagaaagcagcccgtgaaggtggtgtacagcagcaaggaccccgcccagcccaaggagagcagcaaggtggacgccaacgaggaggtggaggccctgatcgtgaagagcccccagaaggagtggaaccccagcctgttcaaggtgctgtacaagaccttcggcccctacttcctgatgagcttcttcttcaaggccatccacgacctgatgatgttcagcggcccccagatcctgaagctgctgatcaagttcgtgaacgacaccaaggcccccgactggcagggctacttctacaccgtgctgctgttcgtgaccgcctgcctgcagaccctggtgctgcaccagtacttccacatctgcttcgtgagcggcatgagaatcaagaccgccgtgatcggcgccgtgtacagaaaggccctggtgatcaccaacagcgccagaaagagcagcaccgtgggcgagatcgtgaacctgatgagcgtggacgcccagagattcatggacctggccacctacatcaacatgatctggagcgcccccctgcaggtgatcctggccctgtacctgctgtggctgaacctgggccccagcgtgctggccggcgtggccgtgatggtgctgatggtgcccgtgaacgccgtgatggccatgaagaccaagacctaccaggtggcccacatgaagagcaaggacaacagaatcaagctgatgaacgagatcctgaacggcatcaaggtgctgaagctgtacgcctgggagctggccttcaaggacaaggtgctggccatcagacaggaggagctgaaggtgctgaagaagagcgcctacctgagcgccgtgggcaccttcacctgggtgtgcacccccttcctggtggccctgtgcaccttcgccgtgtacgtgaccatcgacgagaacaacatcctggacgcccagaccgccttcgtgagcctggccctgttcaacatcctgagattccccctgaacatcctgcccatggtgatcagcagcatcgtgcaggccagcgtgagcctgaagagactgagaatcttcctgagccacgaggagctggagcccgacagcatcgagagaagacccgtgaaggacggcggcggcaccaacagcatcaccgtgagaaacgccaccttcacctgggccagaagcgacccccccaccctgaacggcatcaccttcagcatccccgagggcgccctggtggccgtggtgggccaggtgggctgcggcaagagcagcctgctgagcgccctgctggccgagatggacaaggtggagggccacgtggccatcaagggcagcgtggcctacgtgccccagcaggcctggatccagaacgacagcctgagagagaacatcctgttcggctgccagctggaggagccctactacagaagcgtgatccaggcctgcgccctgctgcccgacctggagatcctgcccagcggcgacagaaccgagatcggcgagaagggcgtgaacctgagcggcggccagaagcagagagtgagcctggccagagccgtgtacagcaacgccgacatctacctgttcgacgaccccctgagcgccgtggacgcccacgtgggcaagcacatcttcgagaacgtgatcggccccaagggcatgctgaagaacaagaccagaatcctggtgacccacagcatgagctacctgccccaggtggacgtgatcatcgtgatgagcggcggcaagatcagcgagatgggcagctaccaggagctgctggccagagacggcgccttcgccgagttcctgagaacctacgccagcaccgagcaggagcaggacgccgaggagaacggcgtgaccggcgtgagcggccccggcaaggaggccaagcagatggagaacggcatgctggtgaccgacagcgccggcaagcagctgcagagacagctgagcagcagcagcagctacagcggcgacatcagcagacaccacaacagcaccgccgagctgcagaaggccgaggccaagaaggaggagacctggaagctgatggaggccgacaaggcccagaccggccaggtgaagctgagcgtgtactgggactacatgaaggccatcggcctgttcatcagcttcctgagcatcttcctgttcatgtgcaaccacgtgagcgccctggccagcaactactggctgagcctgtggaccgacgaccccatcgtgaacggcacccaggagcacaccaaggtgagactgagcgtgtacggcgccctgggcatcagccagggcatcgccgtgttcggctacagcatggccgtgagcatcggcggcatcctggccagcagatgcctgcacgtggacctgctgcacagcatcctgagaagccccatgagcttcttcgagagaacccccagcggcaacctggtgaacagattcagcaaggagctggacaccgtggacagcatgatccccgaggtgatcaagatgttcatgggcagcctgttcaacgtgatcggcgcctgcatcgtgatcctgctggccacccccatcgccgccatcatcatcccccccctgggcctgatctacttcttcgtgcagagattctacgtggccagcagcagacagctgaagagactggagagcgtgagcagaagccccgtgtacagccacttcaacgagaccctgctgggcgtgagcgtgatcagagccttcgaggagcaggagagattcatccaccagagcgacctgaaggtggacgagaaccagaaggcctactaccccagcatcgtggccaacagatggctggccgtgagactggagtgcgtgggcaactgcatcgtgctgttcgccgccctgttcgccgtgatcagcagacacagcctgagcgccggcctggtgggcctgagcgtgagctacagcctgcaggtgaccacctacctgaactggctggtgagaatgagcagcgagatggagaccaacatcgtggccgtggagagactgaaggagtacagcgagaccgagaaggaggccccctggcagatccaggagaccgccccccccagcagctggccccaggtgggcagagtggagttcagaaactactgcctgagatacagagaggacctggacttcgtgctgagacacatcaacgtgaccatcaacggcggcgagaaggtgggcatcgtgggcagaaccggcgccggcaagagcagcctgaccctgggcctgttcagaatcaacgagagcgccgagggcgagatcatcatcgacggcatcaacatcgccaagatcggcctgcacgacctgagattcaagatcaccatcatcccccaggaccccgtgctgttcagcggcagcctgagaatgaacctggaccccttcagccagtacagcgacgaggaggtgtggaccagcctggagctggcccacctgaaggacttcgtgagcgccctgcccgacaagctggaccacgagtgcgccgagggcggcgagaacctgagagtgatcgtgctggacaagggcgagatccaggagtacggcgcccccagcgacctgctgcagcagagaggcctgttctacagcatggccaaggacgccggcctggtgtag

SEQ ID NO: 9449 - DNA, 4428 bp, Artificial Sequence
  Description of Artificial Sequence: Synthetic coding sequence
atggccctgagaggcttctgcagcgccgacggcagcgaccccctgtgggactggaacgtgacctggaacaccagcaaccccgacttcaccaagtgcttccagaacaccgtgctggtgtgggtgccctgcttctacctgtgggcctgcttccccttctacttcctgtacctgagcagacacgacagaggctacatccagatgacccccctgaacaagaccaagaccgccctgggcttcctgctgtggatcgtgtgctgggccgacctgttctacagcttctgggagagaagcagaggcatcttcctggcccccgtgttcctggtgagccccaccctgctgggcatcaccatgctgctggccaccttcctgatccagctggagagaagaaagggcgtgcagagcagcggcatcatgctgaccttctggctggtggccctggtgtgcgccctggccatcctgagaagcaagatcatgaccgccctgaaggaggacgcccaggtggacctgttcagagacatcaccttctacgtgtacttcagcctgctgctgatccagctggtgctgagctgcttcagcgacagaagccccctgttcagcgagaccatccacgaccccaacccctgccccgagagcagcgccagcttcctgagcagaatcaccttctggtggatcaccggcctgatcgtgagaggctacagacagcccctggagggcagcgacctgtggagcctgaacaaggaggacaccagcgagcaggtggtgcccgtgctggtgaagaactggaagaaggagtgcgccaagaccagaaagcagcccgtgaaggtggtgtacagcagcaaggaccccgcccagcccaaggagagcagcaaggtggacgccaacgaggaggtggaggccctgatcgtgaagagcccccagaaggagtggaaccccagcctgttcaaggtgctgtacaagaccttcggcccctacttcctgatgagcttcttcttcaaggccatccacgacctgatgatgttcagcggcccccagatcctgaagctgctgatcaagttcgtgaacgacaccaaggcccccgactggcagggctacttctacaccgtgctgctgttcgtgaccgcctgcctgcagaccctggtgctgcaccagtacttccacatctgcttcgtgagcggcatgagaatcaagaccgccgtgatcggcgccgtgtacagaaaggccctggtgatcaccaacagcgccagaaagagcagcaccgtgggcgagatcgtgaacctgatgagcgtggacgcccagagattcatggacctggccacctacatcaacatgatctggagcgcccccctgcaggtgatcctggccctgtacctgctgtggctgaacctgggccccagcgtgctggccggcgtggccgtgatggtgctgatggtgcccgtgaacgccgtgatggccatgaagaccaagacctaccaggtggcccacatgaagagcaaggacaacagaatcaagctgatgaacgagatcctgaacggcatcaaggtgctgaagctgtacgcctgggagctggccttcaaggacaaggtgctggccatcagacaggaggagctgaaggtgctgaagaagagcgcctacctgagcgccgtgggcaccttcacctgggtgtgcacccccttcctggtggccctgtgcaccttcgccgtgtacgtgaccatcgacgagaacaacatcctggacgcccagaccgccttcgtgagcctggccctgttcaacatcctgagattccccctgaacatcctgcccatggtgatcagcagcatcgtgcaggccagcgtgagcctgaagagactgagaatcttcctgagccacgaggagctggagcccgacagcatcgagagaagacccgtgaaggacggcggcggcaccaacagcatcaccgtgagaaacgccaccttcacctgggccagaagcgacccccccaccctgaacggcatcaccttcagcatccccgagggcgccctggtggccgtggtgggccaggtgggctgcggcaagagcagcctgctgagcgccctgctggccgagatggacaaggtggagggccacgtggccatcaagggcagcgtggcctacgtgccccagcaggcctggatccagaacgacagcctgagagagaacatcctgttcggctgccagctggaggagccctactacagaagcgtgatccaggcctgcgccctgctgcccgacctggagatcctgcccagcggcgacagaaccgagatcggcgagaagaccagaatcctggtgacccacagcatgagctacctgccccaggtggacgtgatcatcgtgatgagcggcggcaagatcagcgagatgggcagctaccaggagctgctggccagagacggcgccttcgccgagttcctgagaacctacgccagcaccgagcaggagcaggacgccgaggagaacggcgtgaccggcgtgagcggccccggcaaggaggccaagcagatggagaacggcatgctggtgaccgacagcgccggcaagcagctgcagagacagctgagcagcagcagcagctacagcggcgacatcagcagacaccacaacagcaccgccgagctgcagaaggccgaggccaagaaggaggagacctggaagctgatggaggccgacaaggcccagaccggccaggtgaagctgagcgtgtactgggactacatgaaggccatcggcctgttcatcagcttcctgagcatcttcctgttcatgtgcaaccacgtgagcgccctggccagcaactactggctgagcctgtggaccgacgaccccatcgtgaacggcacccaggagcacaccaaggtgagactgagcgtgtacggcgccctgggcatcagccagggcatcgccgtgttcggctacagcatggccgtgagcatcggcggcatcctggccagcagatgcctgcacgtggacctgctgcacagcatcctgagaagccccatgagcttcttcgagagaacccccagcggcaacctggtgaacagattcagcaaggagctggacaccgtggacagcatgatccccgaggtgatcaagatgttcatgggcagcctgttcaacgtgatcggcgcctgcatcgtgatcctgctggccacccccatcgccgccatcatcatcccccccctgggcctgatctacttcttcgtgcagagattctacgtggccagcagcagacagctgaagagactggagagcgtgagcagaagccccgtgtacagccacttcaacgagaccctgctgggcgtgagcgtgatcagagccttcgaggagcaggagagattcatccaccagagcgacctgaaggtggacgagaaccagaaggcctactaccccagcatcgtggccaacagatggctggccgtgagactggagtgcgtgggcaactgcatcgtgctgttcgccgccctgttcgccgtgatcagcagacacagcctgagcgccggcctggtgggcctgagcgtgagctacagcctgcaggtgaccacctacctgaactggctggtgagaatgagcagcgagatggagaccaacatcgtggccgtggagagactgaaggagtacagcgagaccgagaaggaggccccctggcagatccaggagaccgccccccccagcagctggccccaggtgggcagagtggagttcagaaactactgcctgagatacagagaggacctggacttcgtgctgagacacatcaacgtgaccatcaacggcggcgagaaggtgggcatcgtgggcagaaccggcgccggcaagagcagcctgaccctgggcctgttcagaatcaacgagagcgccgagggcgagatcatcatcgacggcatcaacatcgccaagatcggcctgcacgacctgagattcaagatcaccatcatcccccaggaccccgtgctgttcagcggcagcctgagaatgaacctggaccccttcagccagtacagcgacgaggaggtgtggaccagcctggagctggcccacctgaaggacttcgtgagcgccctgcccgacaagctggaccacgagtgcgccgagggcggcgagaacctgagcgtgggccagagacagctggtgtgcctggccagagccctgctgagaaagaccaagatcctggtgctggacgaggccaccgccgccgtggacctggagaccgacgacctgatccagagcaccatcagaacccagttcgaggactgcaccgtgctgaccatcgcccacagactgaacaccatcatggactacaccagagtgatcgtgctggacaagggcgagatccaggagtacggcgcccccagcgacctgctgcagcagagaggcctgttctacagcatggccaaggacgccggcctggtgtag

SEQ ID NO: 9450 - DNA, 4251 bp, Artificial Sequence
  Description of Artificial Sequence: Synthetic coding sequence
atggccctgagaggcttctgcagcgccgacggcagcgaccccctgtgggactggaacgtgacctggaacaccagcaaccccgacttcaccaagtgcttccagaacaccgtgctggtgtgggtgccctgcttctacctgtgggcctgcttccccttctacttcctgtacctgagcagacacgacagaggctacatccagatgacccccctgaacaagaccaagaccgccctgggcttcctgctgtggatcgtgtgctgggccgacctgttctacagcttctgggagagaagcagaggcatcttcctggcccccgtgttcctggtgagccccaccctgctgggcatcaccatgctgctggccaccttcctgatccagctggagagaagaaagggcgtgcagagcagcggcatcatgctgaccttctggctggtggccctggtgtgcgccctggccatcctgagaagcaagatcatgaccgccctgaaggaggacgcccaggtggacctgttcagagacatcaccttctacgtgtacttcagcctgctgctgatccagctggtgctgagctgcttcagcgacagaagccccctgttcagcgagaccatccacgaccccaacccctgccccgagagcagcgccagcttcctgagcagaatcaccttctggtggatcaccggcctgatcgtgagaggctacagacagcccctggagggcagcgacctgtggagcctgaacaaggaggacaccagcgagcaggtggtgcccgtgctggtgaagaactggaagaaggagtgcgccaagaccagaaagcagcccgtgaaggtggtgtacagcagcaaggaccccgcccagcccaaggagagcagcaaggtggacgccaacgaggaggtggaggccctgatcgtgaagagcccccagaaggagtggaaccccagcctgttcaaggtgctgtacaagaccttcggcccctacttcctgatgagcttcttcttcaaggccatccacgacctgatgatgttcagcggcccccagatcctgaagctgctgatcaagttcgtgaacgacaccaaggcccccgactggcagggctacttctacaccgtgctgctgttcgtgaccgcctgcctgcagaccctggtgctgcaccagtacttccacatctgcttcgtgagcggcatgagaatcaagaccgccgtgatcggcgccgtgtacagaaaggccctggtgatcaccaacagcgccagaaagagcagcaccgtgggcgagatcgtgaacctgatgagcgtggacgcccagagattcatggacctggccacctacatcaacatgatctggagcgcccccctgcaggtgatcctggccctgtacctgctgtggctgaacctgggccccagcgtgctggccggcgtggccgtgatggtgctgatggtgcccgtgaacgccgtgatggccatgaagaccaagacctaccaggtggcccacatgaagagcaaggacaacagaatcaagctgatgaacgagatcctgaacggcatcaaggtgctgaagctgtacgcctgggagctggccttcaaggacaaggtgctggccatcagacaggaggagctgaaggtgctgaagaagagcgcctacctgagcgccgtgggcaccttcacctgggtgtgcacccccttcctggtggccctgtgcaccttcgccgtgtacgtgaccatcgacgagaacaacatcctggacgcccagaccgccttcgtgagcctggccctgttcaacatcctgagattccccctgaacatcctgcccatggtgatcagcagcatcgtgcaggccagcgtgagcctgaagagactgagaatcttcctgagccacgaggagctggagcccgacagcatcgagagaagacccgtgaaggacggcggcggcaccaacagcatcaccgtgagaaacgccaccttcacctgggccagaagcgacccccccaccctgaacggcatcaccttcagcatccccgagggcgccctggtggccgtggtgggccaggtgggctgcggcaagagcagcctgctgagcgccctgctggccgagatggacaaggtggagggccacgtggccatcaagaccagaatcctggtgacccacagcatgagctacctgccccaggtggacgtgatcatcgtgatgagcggcggcaagatcagcgagatgggcagctaccaggagctgctggccagagacggcgccttcgccgagttcctgagaacctacgccagcaccgagcaggagcaggacgccgaggagaacggcgtgaccggcgtgagcggccccggcaaggaggccaagcagatggagaacggcatgctggtgaccgacagcgccggcaagcagctgcagagacagctgagcagcagcagcagctacagcggcgacatcagcagacaccacaacagcaccgccgagctgcagaaggccgaggccaagaaggaggagacctggaagctgatggaggccgacaaggcccagaccggccaggtgaagctgagcgtgtactgggactacatgaaggccatcggcctgttcatcagcttcctgagcatcttcctgttcatgtgcaaccacgtgagcgccctggccagcaactactggctgagcctgtggaccgacgaccccatcgtgaacggcacccaggagcacaccaaggtgagactgagcgtgtacggcgccctgggcatcagccagggcatcgccgtgttcggctacagcatggccgtgagcatcggcggcatcctggccagcagatgcctgcacgtggacctgctgcacagcatcctgagaagccccatgagcttcttcgagagaacccccagcggcaacctggtgaacagattcagcaaggagctggacaccgtggacagcatgatccccgaggtgatcaagatgttcatgggcagcctgttcaacgtgatcggcgcctgcatcgtgatcctgctggccacccccatcgccgccatcatcatcccccccctgggcctgatctacttcttcgtgcagagattctacgtggccagcagcagacagctgaagagactggagagcgtgagcagaagccccgtgtacagccacttcaacgagaccctgctgggcgtgagcgtgatcagagccttcgaggagcaggagagattcatccaccagagcgacctgaaggtggacgagaaccagaaggcctactaccccagcatcgtggccaacagatggctggccgtgagactggagtgcgtgggcaactgcatcgtgctgttcgccgccctgttcgccgtgatcagcagacacagcctgagcgccggcctggtgggcctgagcgtgagctacagcctgcaggtgaccacctacctgaactggctggtgagaatgagcagcgagatggagaccaacatcgtggccgtggagagactgaaggagtacagcgagaccgagaaggaggccccctggcagatccaggagaccgccccccccagcagctggccccaggtgggcagagtggagttcagaaactactgcctgagatacagagaggacctggacttcgtgctgagacacatcaacgtgaccatcaacggcggcgagaaggtgggcatcgtgggcagaaccggcgccggcaagagcagcctgaccctgggcctgttcagaatcaacgagagcgccgagggcgagatcatcatcgacggcatcaacatcgccaagatcggcctgcacgacctgagattcaagatcaccatcatcccccaggaccccgtgctgttcagcggcagcctgagaatgaacctggaccccttcagccagtacagcgacgaggaggtgtggaccagcctggagctggcccacctgaaggacttcgtgagcgccctgcccgacaagctggaccacgagtgcgccgagggcggcgagaacctgagcgtgggccagagacagctggtgtgcctggccagagccctgctgagaaagaccaagatcctggtgctggacgaggccaccgccgccgtggacctggagaccgacgacctgatccagagcaccatcagaacccagttcgaggactgcaccgtgctgaccatcgcccacagactgaacaccatcatggactacaccagagtgatcgtgctggacaagggcgagatccaggagtacggcgcccccagcgacctgctgcagcagagaggcctgttctacagcatggccaaggacgccggcctggtgtag

SEQ ID NO: 9451 - DNA, 4419 bp, Artificial Sequence
  Description of Artificial Sequence: Synthetic coding sequence
atggccctgagaggcttctgcagcgccgacggcagcgaccccctgtgggactggaacgtgacctggaacaccagcaaccccgacttcaccaagtgcttccagaacaccgtgctggtgtgggtgccctgcttctacctgtgggcctgcttccccttctacttcctgtacctgagcagacacgacagaggctacatccagatgacccccctgaacaagaccaagaccgccctgggcttcctgctgtggatcgtgtgctgggccgacctgttctacagcttctgggagagaagcagaggcatcttcctggcccccgtgttcctggtgagccccaccctgctgggcatcaccatgctgctggccaccttcctgatccagctggagagaagaaagggcgtgcagagcagcggcatcatgctgaccttctggctggtggccctggtgtgcgccctggccatcctgagaagcaagatcatgaccgccctgaaggaggacgcccaggtggacctgttcagagacatcaccttctacgtgtacttcagcctgctgctgatccagctggtgctgagctgcttcagcgacagaagccccctgttcagcgagaccatccacgaccccaacccctgccccgagagcagcgccagcttcctgagcagaatcaccttctggtggatcaccggcctgatcgtgagaggctacagacagcccctggagggcagcgacctgtggagcctgaacaaggaggacaccagcgagcaggtggtgcccgtgctggtgaagaactggaagaaggagtgcgccaagaccagaaagcagcccgtgaaggtggtgtacagcagcaaggaccccgcccagcccaaggagagcagcaaggtggacgccaacgaggaggtggaggccctgatcgtgaagagcccccagaaggagtggaaccccagcctgttcaaggtgctgtacaagaccttcggcccctacttcctgatgagcttcttcttcaaggccatccacgacctgatgatgttcagcggcccccagatcctgaagctgctgatcaagttcgtgaacgacaccaaggcccccgactggcagggctacttctacaccgtgctgctgttcgtgaccgcctgcctgcagaccctggtgctgcaccagtacttccacatctgcttcgtgagcggcatgagaatcaagaccgccgtgatcggcgccgtgtacagaaaggccctggtgatcaccaacagcgccagaaagagcagcaccgtgggcgagatcgtgaacctgatgagcgtggacgcccagagattcatggacctggccacctacatcaacatgatctggagcgcccccctgcaggtgatcctggccctgtacctgctgtggctgaacctgggccccagcgtgctggccggcgtggccgtgatggtgctgatggtgcccgtgaacgccgtgatggccatgaagaccaagacctaccaggtggcccacatgaagagcaaggacaacagaatcaagctgatgaacgagatcctgaacggcatcaaggtgctgaagctgtacgcctgggagctggccttcaaggacaaggtgctggccatcagacaggaggagctgaaggtgctgaagaagagcgcctacctgagcgccgtgggcaccttcacctgggtgtgcacccccttcctggtggccctgtgcaccttcgccgtgtacgtgaccatcgacgagaacaacatcctggacgcccagaccgccttcgtgagcctggccctgttcaacatcctgagattccccctgaacatcctgcccatggtgatcagcagcatcgtgcaggccagcgtgagcctgaagagactgagaatcttcctgagccacgaggagctggagcccgacagcatcgagagaagacccgtgaaggacggcggcggcaccaacagcatcaccgtgagaaacgccaccttcacctgggccagaagcgacccccccaccctgaacggcatcaccttcagcatccccgagggcgccctggtggccgtggtgggccaggtgggctgcggcaagagcagcctgctgagcgccctgctggccgagatggacaaggtggagggccacgtggccatcaagggcgtgaacctgagcggcggccagaagcagagagtgagcctggccagagccgtgtacagcaacgccgacatctacctgttcgacgaccccctgagcgccgtggacgcccacgtgggcaagcacatcttcgagaacgtgatcggccccaagggcatgctgaagaacaagaccagaatcctggtgacccacagcatgagctacctgccccaggtggacgtgatcatcgtgatgagcggcggcaagatcagcgagatgggcagctaccaggagctgctggccagagacggcgccttcgccgagttcctgagaacctacgccagcaccgagcaggagcaggacgccgaggagaacggcgtgaccggcgtgagcggccccggcaaggaggccaagcagatggagaacggcatgctggtgaccgacagcgccggcaagcagctgcagagacagctgagcagcagcagcagctacagcggcgacatcagcagacaccacaacagcaccgccgagctgcagaaggccgaggccaagaaggaggagacctggaagctgatggaggccgacaaggcccagaccggccaggtgaagctgagcgtgtactgggactacatgaaggccatcggcctgttcatcagcttcctgagcatcttcctgttcatgtgcaaccacgtgagcgccctggccagcaactactggctgagcctgtggaccgacgaccccatcgtgaacggcacccaggagcacaccaaggtgagactgagcgtgtacggcgccctgggcatcagccagggcatcgccgtgttcggctacagcatggccgtgagcatcggcggcatcctggccagcagatgcctgcacgtggacctgctgcacagcatcctgagaagccccatgagcttcttcgagagaacccccagcggcaacctggtgaacagattcagcaaggagctggacaccgtggacagcatgatccccgaggtgatcaagatgttcatgggcagcctgttcaacgtgatcggcgcctgcatcgtgatcctgctggccacccccatcgccgccatcatcatcccccccctgggcctgatctacttcttcgtgcagagattctacgtggccagcagcagacagctgaagagactggagagcgtgagcagaagccccgtgtacagccacttcaacgagaccctgctgggcgtgagcgtgatcagagccttcgaggagcaggagagattcatccaccagagcgacctgaaggtggacgagaaccagaaggcctactaccccagcatcgtggccaacagatggctggccgtgagactggagtgcgtgggcaactgcatcgtgctgttcgccgccctgttcgccgtgatcagcagacacagcctgagcgccggcctggtgggcctgagcgtgagctacagcctgcaggtgaccacctacctgaactggctggtgagaatgagcagcgagatggagaccaacatcgtggccgtggagagactgaaggagtacagcgagaccgagaaggaggccccctggcagatccaggagaccgccccccccagcagctggccccaggtgggcagagtggagttcagaaactactgcctgagatacagagaggacctggacttcgtgctgagacacatcaacgtgaccatcaacggcggcgagaaggtgggcatcgtgggcagaaccggcgccggcaagagcagcctgaccctgggcctgttcagaatcaacgagagcgccgagggcgagatcatcatcgacggcatcaacatcgccaagatcggcctgcacgacctgagattcaagatcaccatcatcccccaggaccccgtgctgttcagcggcagcctgagaatgaacctggaccccttcagccagtacagcgacgaggaggtgtggaccagcctggagctggcccacctgaaggacttcgtgagcgccctgcccgacaagctggaccacgagtgcgccgagggcggcgagaacctgagcgtgggccagagacagctggtgtgcctggccagagccctgctgagaaagaccaagatcctggtgctggacgaggccaccgccgccgtggacctggagaccgacgacctgatccagagcaccatcagaacccagttcgaggactgcaccgtgctgaccatcgcccacagactgaacaccatcatggactacaccagagtgatcgtgctggacaagggcgagatccaggagtacggcgcccccagcgacctgctgcagcagagaggcctgttctacagcatggccaaggacgccggcctggtgtag

SEQ ID NO: 9452 - DNA, 4626 bp, Artificial Sequence
  Description of Artificial Sequence: Synthetic coding sequence
atggccctgagaggcttctgcagcgccgacggcagcgaccccctgtgggactggaacgtgacctggaacaccagcaaccccgacttcaccaagtgcttccagaacaccgtgctggtgtgggtgccctgcttctacctgtgggcctgcttccccttctacttcctgtacctgagcagacacgacagaggctacatccagatgacccccctgaacaagaccaagaccgccctgggcttcctgctgtggatcgtgtgctgggccgacctgttctacagcttctgggagagaagcagaggcatcttcctggcccccgtgttcctggtgagccccaccctgctgggcatcaccatgctgctggccaccttcctgatccagctggagagaagaaagggcgtgcagagcagcggcatcatgctgaccttctggctggtggccctggtgtgcgccctggccatcctgagaagcaagatcatgaccgccctgaaggaggacgcccaggtggacctgttcagagacatcaccttctacgtgtacttcagcctgctgctgatccagctggtgctgagctgcttcagcgacagaagccccctgttcagcgagaccatccacgaccccaacccctgccccgagagcagcgccagcttcctgagcagaatcaccttctggtggatcaccggcctgatcgtgagaggctacagacagcccctggagggcagcgacctgtggagcctgaacaaggaggacaccagcgagcaggtggtgcccgtgctggtgaagaactggaagaaggagtgcgccaagaccagaaagcagcccgtgaaggtggtgtacagcagcaaggaccccgcccagcccaaggagagcagcaaggtggacgccaacgaggaggtggaggccctgatcgtgaagagcccccagaaggagtggaaccccagcctgttcaaggtgctgtacaagaccttcggcccctacttcctgatgagcttcttcttcaaggccatccacgacctgatgatgttcagcggcccccagatcctgaagctgctgatcaagttcgtgaacgacaccaaggcccccgactggcagggctacttctacaccgtgctgctgttcgtgaccgcctgcctgcagaccctggtgctgcaccagtacttccacatctgcttcgtgagcggcatgagaatcaagaccgccgtgatcggcgccgtgtacagaaaggccctggtgatcaccaacagcgccagaaagagcagcaccgtgggcgagatcgtgaacctgatgagcgtggacgcccagagattcatggacctggccacctacatcaacatgatctggagcgcccccctgcaggtgatcctggccctgtacctgctgtggctgaacctgggccccagcgtgctggccggcgtggccgtgatggtgctgatggtgcccgtgaacgccgtgatggccatgaagaccaagacctaccaggtggcccacatgaagagcaaggacaacagaatcaagctgatgaacgagatcctgaacggcatcaaggtgctgaagctgtacgcctgggagctggccttcaaggacaaggtgctggccatcagacaggaggagctgaaggtgctgaagaagagcgcctacctgagcgccgtgggcaccttcacctgggtgtgcacccccttcctggtggccctgtgcaccttcgccgtgtacgtgaccatcgacgagaacaacatcctggacgcccagaccgccttcgtgagcctggccctgttcaacatcctgagattccccctgaacatcctgcccatggtgatcagcagcatcgtgcaggccagcgtgagcctgaagagactgagaatcttcctgagccacgaggagctggagcccgacagcatcgagagaagacccgtgaaggacggcggcggcaccaacagcatcaccgtgagaaacgccaccttcacctgggccagaagcgacccccccaccctgaacggcatcaccttcagcatccccgagggcgccctggtggccgtggtgggccaggtgggctgcggcaagagcagcctgctgagcgccctgctggccgagatggacaaggtggagggccacgtggccatcaagggcagcgtggcctacgtgccccagcaggcctggatccagaacgacagcctgagagagaacatcctgttcggctgccagctggaggagccctactacagaagcgtgatccaggcctgcgccctgctgcccgacctggagatcctgcccagcggcgacagaaccgagatcggcgagaagggcgtgaacctgagcggcggccagaagcagagagtgagcctggccagagccgtgtacagcaacgccgacatctacctgttcgacgaccccctgagcgccgtggacgcccacgtgggcaagcacatcttcgagaacgtgatcggccccaagggcatgctgaagaacaagaccagaatcctggtgacccacagcatgagctacctgccccaggtggacgtgatcatcgtgatgagcggcggcaagatcagcgagatgggcagctaccaggagctgctggccagagacggcgccttcgccgagttcctgagaacctacgccagcaccgagcaggagcaggacgccgaggagaacggcagcaccgtgatggacgaggaggaggccggcgtgaccggcgtgagcggccccggcaaggaggccaagcagatggagaacggcatgctggtgaccgacagcgccggcaagcagctgcagagacagctgagcagcagcagcagctacagcggcgacatcagcagacaccacaacagcaccgccgagctgcagaaggccgaggccaagaaggaggagacctggaagctgatggaggccgacaaggcccagaccggccaggtgaagctgagcgtgtactgggactacatgaaggccatcggcctgttcatcagcttcctgagcatcttcctgttcatgtgcaaccacgtgagcgccctggccagcaactactggctgagcctgtggaccgacgaccccatcgtgaacggcacccaggagcacaccaaggtgagactgagcgtgtacggcgccctgggcatcagccagggcatcgccgtgttcggctacagcatggccgtgagcatcggcggcatcctggccagcagatgcctgcacgtggacctgctgcacagcatcctgagaagccccatgagcttcttcgagagaacccccagcggcaacctggtgaacagattcagcaaggagctggacaccgtggacagcatgatccccgaggtgatcaagatgttcatgggcagcctgttcaacgtgatcggcgcctgcatcgtgatcctgctggccacccccatcgccgccatcatcatcccccccctgggcctgatctacttcttcgtgcagagattctacgtggccagcagcagacagctgaagagactggagagcgtgagcagaagccccgtgtacagccacttcaacgagaccctgctgggcgtgagcgtgatcagagccttcgaggagcaggagagattcatccaccagagcgacctgaaggtggacgagaaccagaaggcctactaccccagcatcgtggccaacagatggctggccgtgagactggagtgcgtgggcaactgcatcgtgctgttcgccgccctgttcgccgtgatcagcagacacagcctgagcgccggcctggtgggcctgagcgtgagctacagcctgcaggtgaccacctacctgaactggctggtgagaatgagcagcgagatggagaccaacatcgtggccgtggagagactgaaggagtacagcgagaccgagaaggaggccccctggcagatccaggagaccgccccccccagcagctggccccaggtgggcagagtggagttcagaaactactgcctgagatacagagaggacctggacttcgtgctgagacacatcaacgtgaccatcaacggcggcgagaaggtgggcatcgtgggcagaaccggcgccggcaagagcagcctgaccctgggcctgttcagaatcaacgagagcgccgagggcgagatcatcatcgacggcatcaacatcgccaagatcggcctgcacgacctgagattcaagatcaccatcatcccccaggaccccgtgctgttcagcggcagcctgagaatgaacctggaccccttcagccagtacagcgacgaggaggtgtggaccagcctggagctggcccacctgaaggacttcgtgagcgccctgcccgacaagctggaccacgagtgcgccgagggcggcgagaacctgagcgtgggccagagacagctggtgtgcctggccagagccctgctgagaaagaccaagatcctggtgctggacgaggccaccgccgccgtggacctggagaccgacgacctgatccagagcaccatcagaacccagttcgaggactgcaccgtgctgaccatcgcccacagactgaacaccatcatggactacaccagagtgatcgtgctggacaagggcgagatccaggagtacggcgcccccagcgacctgctgcagcagagaggcctgttctacagcatggccaaggacgccggcctggtgtag

SEQ ID NO: 9453 - DNA, 4596 bp, Artificial Sequence
  Description of Artificial Sequence: Synthetic coding sequence
atggccctgagaggcttctgcagcgccgacggcagcgaccccctgtgggactggaacgtgacctggaacaccagcaaccccgacttcaccaagtgcttccagaacaccgtgctggtgtgggtgccctgcttctacctgtgggcctgcttccccttctacttcctgtacctgagcagacacgacagaggctacatccagatgacccccctgaacaagaccaagaccgccctgggcttcctgctgtggatcgtgtgctgggccgacctgttctacagcttctgggagagaagcagaggcatcttcctggcccccgtgttcctggtgagccccaccctgctgggcatcaccatgctgctggccaccttcctgatccagctggagagaagaaagggcgtgcagagcagcggcatcatgctgaccttctggctggtggccctggtgtgcgccctggccatcctgagaagcaagatcatgaccgccctgaaggaggacgcccaggtggacctgttcagagacatcaccttctacgtgtacttcagcctgctgctgatccagctggtgctgagctgcttcagcgacagaagccccctgttcagcgagaccatccacgaccccaacccctgccccgagagcagcgccagcttcctgagcagaatcaccttctggtggatcaccggcctgatcgtgagaggctacagacagcccctggagggcagcgacctgtggagcctgaacaaggaggacaccagcgagcaggtggtgcccgtgctggtgaagaactggaagaaggagtgcgccaagaccagaaagcagcccgtgaaggtggtgtacagcagcaaggaccccgcccagcccaaggagagcagcaaggtggacgccaacgaggaggtggaggccctgatcgtgaagagcccccagaaggagtggaaccccagcctgttcaaggtgctgtacaagaccttcggcccctacttcctgatgagcttcttcttcaaggccatccacgacctgatgatgttcagcggcccccagatcctgaagctgctgatcaagttcgtgaacgacaccaaggcccccgactggcagggctacttctacaccgtgctgctgttcgtgaccgcctgcctgcagaccctggtgctgcaccagtacttccacatctgcttcgtgagcggcatgagaatcaagaccgccgtgatcggcgccgtgtacagaaaggccctggtgatcaccaacagcgccagaaagagcagcaccgtgggcgagatcgtgaacctgatgagcgtggacgcccagagattcatggacctggccacctacatcaacatgatctggagcgcccccctgcaggtgatcctggccctgtacctgctgtggctgaacctgggccccagcgtgctggccggcgtggccgtgatggtgctgatggtgcccgtgaacgccgtgatggccatgaagaccaagacctaccaggtggcccacatgaagagcaaggacaacagaatcaagctgatgaacgagatcctgaacggcatcaaggtgctgaagctgtacgcctgggagctggccttcaaggacaaggtgctggccatcagacaggaggagctgaaggtgctgaagaagagcgcctacctgagcgccgtgggcaccttcacctgggtgtgcacccccttcctggtggccctgtgcaccttcgccgtgtacgtgaccatcgacgagaacaacatcctggacgcccagaccgccttcgtgagcctggccctgttcaacatcctgagattccccctgaacatcctgcccatggtgatcagcagcatcgtgcaggccagcgtgagcctgaagagactgagaatcttcctgagccacgaggagctggagcccgacagcatcgagagaagacccgtgaaggacggcggcggcaccaacagcatcaccgtgagaaacgccaccttcacctgggccagaagcgacccccccaccctgaacggcatcaccttcagcatccccgagggcgccctggtggccgtggtgggccaggtgggctgcggcaagagcagcctgctgagcgccctgctggccgagatggacaaggtggagggccacgtggccatcaagggcagcgtggcctacgtgccccagcaggcctggatccagaacgacagcctgagagagaacatcctgttcggctgccagctggaggagccctactacagaagcgtgatccaggcctgcgccctgctgcccgacctggagatcctgcccagcggcgacagaaccgagatcggcgagaagggcgtgaacctgagcggcggccagaagcagagagtgagcctggccagagccgtgtacagcaacgccgacatctacctgttcgacgaccccctgagcgccgtggacgcccacgtgggcaagcacatcttcgagaacgtgatcggccccaagggcatgctgaagaacaagaccagaatcctggtgacccacagcatgagctacctgccccaggtggacgtgatcatcgtgatgagcggcggcaagatcagcgagatgggcagctaccaggagctgctggccagagacggcgccttcgccgagttcctgagaacctacgccagcaccgagcaggagcaggacgccgaggagaacggcgtgaccggcgtgagcggccccggcaaggaggccaagcagatggagaacggcatgctggtgaccgacagcgccggcaagcagctgcagagacagctgagcagcagcagcagctacagcggcgacatcagcagacaccacaacagcaccgccgagctgcagaaggccgaggccaagaaggaggagacctggaagctgatggaggccgacaaggcccagaccggccaggtgaagctgagcgtgtactgggactacatgaaggccatcggcctgttcatcagcttcctgagcatcttcctgttcatgtgcaaccacgtgagcgccctggccagcaactactggctgagcctgtggaccgacgaccccatcgtgaacggcacccaggagcacaccaaggtgagactgagcgtgtacggcgccctgggcatcagccagggcatcgccgtgttcggctacagcatggccgtgagcatcggcggcatcctggccagcagatgcctgcacgtggacctgctgcacagcatcctgagaagccccatgagcttcttcgagagaacccccagcggcaacctggtgaacagattcagcaaggagctggacaccgtggacagcatgatccccgaggtgatcaagatgttcatgggcagcctgttcaacgtgatcggcgcctgcatcgtgatcctgctggccacccccatcgccgccatcatcatcccccccctgggcctgatctacttcttcgtgcagagattctacgtggccagcagcagacagctgaagagactggagagcgtgagcagaagccccgtgtacagccacttcaacgagaccctgctgggcgtgagcgtgatcagagccttcgaggagcaggagagattcatccaccagagcgacctgaaggtggacgagaaccagaaggcctactaccccagcatcgtggccaacagatggctggccgtgagactggagtgcgtgggcaactgcatcgtgctgttcgccgccctgttcgccgtgatcagcagacacagcctgagcgccggcctggtgggcctgagcgtgagctacagcctgcaggtgaccacctacctgaactggctggtgagaatgagcagcgagatggagaccaacatcgtggccgtggagagactgaaggagtacagcgagaccgagaaggaggccccctggcagatccaggagaccgccccccccagcagctggccccaggtgggcagagtggagttcagaaactactgcctgagatacagagaggacctggacttcgtgctgagacacatcaacgtgaccatcaacggcggcgagaaggtgggcatcgtgggcagaaccggcgccggcaagagcagcctgaccctgggcctgttcagaatcaacgagagcgccgagggcgagatcatcatcgacggcatcaacatcgccaagatcggcctgcacgacctgagattcaagatcaccatcatcccccaggaccccgtgctgttcagcggcagcctgagaatgaacctggaccccttcagccagtacagcgacgaggaggtgtggaccagcctggagctggcccacctgaaggacttcgtgagcgccctgcccgacaagctggaccacgagtgcgccgagggcggcgagaacctgagcgtgggccagagacagctggtgtgcctggccagagccctgctgagaaagaccaagatcctggtgctggacgaggccaccgccgccgtggacctggagaccgacgacctgatccagagcaccatcagaacccagttcgaggactgcaccgtgctgaccatcgcccacagactgaacaccatcatggactacaccagagtgatcgtgctggacaagggcgagatccaggagtacggcgcccccagcgacctgctgcagcagagaggcctgttctacagcatggccaaggacgccggcctggtgtag

SEQ ID NO: 9454 - DNA, 3648 bp, Artificial Sequence
  Description of Artificial Sequence: Synthetic coding sequence
atgagcttcttcttcaaggccatccacgacctgatgatgttcagcggcccccagatcctgaagctgctgatcaagttcgtgaacgacaccaaggcccccgactggcagggctacttctacaccgtgctgctgttcgtgaccgcctgcctgcagaccctggtgctgcaccagtacttccacatctgcttcgtgagcggcatgagaatcaagaccgccgtgatcggcgccgtgtacagaaaggccctggtgatcaccaacagcgccagaaagagcagcaccgtgggcgagatcgtgaacctgatgagcgtggacgcccagagattcatggacctggccacctacatcaacatgatctggagcgcccccctgcaggtgatcctggccctgtacctgctgtggctgaacctgggccccagcgtgctggccggcgtggccgtgatggtgctgatggtgcccgtgaacgccgtgatggccatgaagaccaagacctaccaggtggcccacatgaagagcaaggacaacagaatcaagctgatgaacgagatcctgaacggcatcaaggtgctgaagctgtacgcctgggagctggccttcaaggacaaggtgctggccatcagacaggaggagctgaaggtgctgaagaagagcgcctacctgagcgccgtgggcaccttcacctgggtgtgcacccccttcctggtggccctgtgcaccttcgccgtgtacgtgaccatcgacgagaacaacatcctggacgcccagaccgccttcgtgagcctggccctgttcaacatcctgagattccccctgaacatcctgcccatggtgatcagcagcatcgtgcaggccagcgtgagcctgaagagactgagaatcttcctgagccacgaggagctggagcccgacagcatcgagagaagacccgtgaaggacggcggcggcaccaacagcatcaccgtgagaaacgccaccttcacctgggccagaagcgacccccccaccctgaacggcatcaccttcagcatccccgagggcgccctggtggccgtggtgggccaggtgggctgcggcaagagcagcctgctgagcgccctgctggccgagatggacaaggtggagggccacgtggccatcaagggcagcgtggcctacgtgccccagcaggcctggatccagaacgacagcctgagagagaacatcctgttcggctgccagctggaggagccctactacagaagcgtgatccaggcctgcgccctgctgcccgacctggagatcctgcccagcggcgacagaaccgagatcggcgagaagggcgtgaacctgagcggcggccagaagcagagagtgagcctggccagagccgtgtacagcaacgccgacatctacctgttcgacgaccccctgagcgccgtggacgcccacgtgggcaagcacatcttcgagaacgtgatcggccccaagggcatgctgaagaacaagaccagaatcctggtgacccacagcatgagctacctgccccaggtggacgtgatcatcgtgatgagcggcggcaagatcagcgagatgggcagctaccaggagctgctggccagagacggcgccttcgccgagttcctgagaacctacgccagcaccgagcaggagcaggacgccgaggagaacggcagcaccgtgatggacgaggaggaggccggcgtgaccggcgtgagcggccccggcaaggaggccaagcagatggagaacggcatgctggtgaccgacagcgccggcaagcagctgcagagacagctgagcagcagcagcagctacagcggcgacatcagcagacaccacaacagcaccgccgagctgcagaaggccgaggccaagaaggaggagacctggaagctgatggaggccgacaaggcccagaccggccaggtgaagctgagcgtgtactgggactacatgaaggccatcggcctgttcatcagcttcctgagcatcttcctgttcatgtgcaaccacgtgagcgccctggccagcaactactggctgagcctgtggaccgacgaccccatcgtgaacggcacccaggagcacaccaaggtgagactgagcgtgtacggcgccctgggcatcagccagggcatcgccgtgttcggctacagcatggccgtgagcatcggcggcatcctggccagcagatgcctgcacgtggacctgctgcacagcatcctgagaagccccatgagcttcttcgagagaacccccagcggcaacctggtgaacagattcagcaaggagctggacaccgtggacagcatgatccccgaggtgatcaagatgttcatgggcagcctgttcaacgtgatcggcgcctgcatcgtgatcctgctggccacccccatcgccgccatcatcatcccccccctgggcctgatctacttcttcgtgcagagattctacgtggccagcagcagacagctgaagagactggagagcgtgagcagaagccccgtgtacagccacttcaacgagaccctgctgggcgtgagcgtgatcagagccttcgaggagcaggagagattcatccaccagagcgacctgaaggtggacgagaaccagaaggcctactaccccagcatcgtggccaacagatggctggccgtgagactggagtgcgtgggcaactgcatcgtgctgttcgccgccctgttcgccgtgatcagcagacacagcctgagcgccggcctggtgggcctgagcgtgagctacagcctgcaggtgaccacctacctgaactggctggtgagaatgagcagcgagatggagaccaacatcgtggccgtggagagactgaaggagtacagcgagaccgagaaggaggccccctggcagatccaggagaccgccccccccagcagctggccccaggtgggcagagtggagttcagaaactactgcctgagatacagagaggacctggacttcgtgctgagacacatcaacgtgaccatcaacggcggcgagaaggtgggcatcgtgggcagaaccggcgccggcaagagcagcctgaccctgggcctgttcagaatcaacgagagcgccgagggcgagatcatcatcgacggcatcaacatcgccaagatcggcctgcacgacctgagattcaagatcaccatcatcccccaggaccccgtgctgttcagcggcagcctgagaatgaacctggaccccttcagccagtacagcgacgaggaggtgtggaccagcctggagctggcccacctgaaggacttcgtgagcgccctgcccgacaagctggaccacgagtgcgccgagggcggcgagaacctgagcgtgggccagagacagctggtgtgcctggccagagccctgctgagaaagaccaagatcctggtgctggacgaggccaccgccgccgtggacctggagaccgacgacctgatccagagcaccatcagaacccagttcgaggactgcaccgtgctgaccatcgcccacagactgaacaccatcatggactacaccagagtgatcgtgctggacaagggcgagatccaggagtacggcgcccccagcgacctgctgcagcagagaggcctgttctacagcatggccaaggacgccggcctggtgtag

SEQ ID NO: 9455 - DNA, 1968 bp, Artificial Sequence
  Description of Artificial Sequence: Synthetic coding sequence
atgagcagcagcaacgtggaggtgttcatccccgtgagccagggcaacaccaacggcttccccgccaccgccagcaacgacctgaaggccttcaccgagggcgccgtgctgagcttccacaacatctgctacagagtgaagctgaagagcggcttcctgccctgcagaaagcccgtggagaaggagatcctgagcaacatcaacggcatcatgaagcccggcctgaacgccatcctgggccccaccggcggcggcaagagcagcctgctggacgtgctggccgccagaaaggaccccagcggcctgagcggcgacgtgctgatcaacggcgcccccagacccgccaacttcaagtgcaacagcggctacgtggtgcaggacgacgtggtgatgggcaccctgaccgtgagagagaacctgcagttcagcgccgccctgagactggccaccaccatgaccaaccacgagaagaacgagagaatcaacagagtgatccaggagctgggcctggacaaggtggccgacagcaaggtgggcacccagttcatcagaggcgtgagcggcggcgagagaaagagaaccagcatcggcatggagctgatcaccgaccccagcatcctgttcctggacgagcccaccaccggcctggacagcagcaccgccaacgccgtgctgctgctgctgaagagaatgagcaagcagggcagaaccatcatcttcagcatccaccagcccagatacagcatcttcaagctgttcgacagcctgaccctgctggccagcggcagactgatgttccacggccccgcccaggaggccctgggctacttcgagagcgccggctaccactgcgaggcctacaacaaccccgccgacttcttcctggacatcatcaacggcgacagcaccgccgtggccctgaacagagaggaggacttcaaggccaccgagatcatcgagcccagcaagcaggacaagcccctgatcgagaagctggccgagatctacgtgaacagcagcttctacaaggagaccaaggccgagctgcaccagctgagcggcggcgagaagaagaagaagatcaccgtgttcaaggagatcagctacaccaccagcttctgccaccagctgagatgggtgagcaagagaagcttcaagaacctgctgggcaacccccaggccagcatcgcccagatcatcgtgaccgtggtgctgggcctggtgatcggcgccatctacttcggcctgaagaacgacagcaccggcatccagaacagagccggcgtgctgttcttcctgaccaccaaccagtgcttcagcagcgtgagcgccgtggagctgttcgtggtggagaagaagctgttcatccacgagtacatcagcggctactacagagtgagcagctacttcctgggcaagctgctgagcgacctgctgcccatgagaatgctgcccagcatcatcttcacctgcatcgtgtacttcatgctgggcctgaagcccaaggccgacgccttcttcgtgatgatgttcaccctgatgatggtggcctacagcgccagcagcatggccctggccatcgccgccggccagagcgtggtgagcgtggccaccctgctgatgaccatctgcttcgtgttcatgatgatcttcagcggcctgctggtgaacctgaccaccatcgccagctggctgagctggctgcagtacttcagcatccccagatacggcttcaccgccctgcagcacaacgagttcctgggccagaacttctgccccggcctgaacgccaccggcaacaacccctgcaactacgccacctgcaccggcgaggagtacctggtgaagcagggcatcgacctgagcccctggggcctgtggaagaaccacgtggccctggcctgcatgatcgtgatcttcctgaccatcgcctacctgaagctgctgttcctgaagaagtacagctag

SEQ ID NO: 9456 - DNA, 1836 bp, Artificial Sequence
  Description of Artificial Sequence: Synthetic coding sequence
atgagcagcagcaacgtggaggtgttcatccccgtgagccagggcaacaccaacggcttccccgccaccgccagcaacgacctgaaggccttcaccgagggcgccgtgctgagcttccacaacatctgctacagagtgaagctgaagagcggcttcctgccctgcagaaagcccgtggagaaggagatcctgagcaacatcaacggcatcatgaagcccggcctgaacgccatcctgggccccaccggcggcggcaagagcagcctgctggacgtgctggccgccagaaaggaccccagcggcctgagcggcgacgtgctgatcaacggcgcccccagacccgccaacttcaagtgcaacagcggctacgtggtgcaggacgacgtggtgatgggcaccctgaccgtgagagagaacctgcagttcagcgccgccctgagactggccaccaccatgaccaaccacgagaagaacgagagaatcaacagagtgatccaggagctgggcctggacaaggtggccgacagcaaggtgggcacccagttcatcagaggcgtgagcggcggcgagagaaagagaaccagcatcggcatggagctgatcaccgaccccagcatcctgttcctggacgagcccaccaccggcctggacagcagcaccgccaacgccgtgctgctgctgctgaagagaatgagcaagcagggcagaaccatcatcttcagcatccaccagcccagatacagcatcttcaagctgttcgacagcctgaccctgctggccagcggcagactgatgttccacggccccgcccaggaggccctgggctacttcgagagcgccggctaccactgcgaggcctacaacaaccccgccgacttcttcctggacatcatcaacggcgacagcaccgccgtggccctgaacagagaggaggacttcaaggccaccgagatcatcgagcccagcaagcaggacaagcccctgatcgagaagctggccgagatctacgtgaacagcagcttctacaaggagaccaaggccgagctgcaccagctgagcggcggcgagaagaagaagaagatcaccgtgttcaaggagatcagctacaccaccagcttctgccaccagctgagatgggtgagcaagagaagcttcaagaacctgctgggcaacccccaggccagcatcgcccagatcatcgtgaccgtggtgctgggcctggtgatcggcgccatctacttcggcctgaagaacgacagcaccggcatccagaacagagccggcgtgctgttcttcctgaccaccaaccagtgcttcagcagcgtgagcgccgtggagctgttcgtggtggagaagaagctgttcatccacgagtacatcagcggctactacagagtgagcagctacttcctgggcaagctgctgagcgacctgctgcccatgagaatgctgcccagcatcatcttcacctgcatcgtgtacttcatgctgggcctgaagcccaaggccgacgccttcttcgtgatgatgttcaccctgatgatggtggcctacagcgccagcagcatggccctggccatcgccgccggccagagcgtggtgagcgtggccaccctgctgatgaccatctgcttcgtgttcatgatggtgtgctggagcatcagccagcccctgcacctgggctgccacggcttcagcaccagcgccttccacgacatggacctgagactgtgcagcatcatgaacttctgggacaagaccagcgcccaggacagcatgcagcaggagaccatcctggtgaccatgcagcacgtgctggccaagaacatctggtag

SEQ ID NO: 9457 - DNA, 1212 bp, Artificial Sequence
  Description of Artificial Sequence: Synthetic coding sequence
atggacagaagcaaggagaactgcatcagcggccccgtgaaggccaccgcccccgtgggcggccccaagagagtgctggtgacccagcagttcccctgccagaaccccctgcccgtgaacagcggccaggcccagagagtgctgtgccccagcaacagcagccagagaatccccctgcaggcccagaagctggtgagcagccacaagcccgtgcagaaccagaagcagaagcagctgcaggccaccagcgtgccccaccccgtgagcagacccctgaacaacacccagaagagcaagcagcccctgcccagcgcccccgagaacaaccccgaggaggagctggccagcaagcagaagaacgaggagagcaagaagagacagtgggccctggaggacttcgagatcggcagacccctgggcaagggcaagttcggcaacgtgtacctggccagagagaagcagagcaagttcatcctggccctgaaggtgctgttcaaggcccagctggagaaggccggcgtggagcaccagctgagaagagaggtggagatccagagccacctgagacaccccaacatcctgagactgtacggctacttccacgacgccaccagagtgtacctgatcctggagtacgcccccctgggcaccgtgtacagagagctgcagaagctgagcaagttcgacgagcagagaaccgccacctacatcaccgagctggccaacgccctgagctactgccacagcaagagagtgatccacagagacatcaagcccgagaacctgctgctgggcagcgccggcgagctgaagatcgccgacttcggctggagcgtgcacgcccccagcagcagaagaaccaccctgtgcggcaccctggactacctgccccccgagatgatcgagggcagaatgcacgacgagaaggtggacctgtggagcctgggcgtgctgtgctacgagttcctggtgggcaagccccccttcgaggccaacacctaccaggagacctacaagagaatcagcagagtggagttcaccttccccgacttcgtgaccgagggcgccagagacctgatcagcagactgctgaagcacaaccccagccagagacccatgctgagagaggtgctggagcacccctggatcaccgccaacagcagcaagcccagcaactgccagaacaaggagagcgccagcaagcagagctag

SEQ ID NO: 9458 - DNA, 1212 bp, Artificial Sequence; identical to SEQ ID NO: 9457
  Description of Artificial Sequence: Synthetic coding sequence

SEQ ID NO: 9459 - DNA, 1212 bp, Artificial Sequence; identical to SEQ ID NO: 9457
  Description of Artificial Sequence: Synthetic coding sequence

SEQ ID NO: 9460 - DNA, 1044 bp, Artificial Sequence
  Description of Artificial Sequence: Synthetic coding sequence
atggacagaagcaaggagaactgcatcagcggccccgtgaaggccaccgcccccgtgggcggccccaagagagtgctggtgacccagcagttcccctgccagaaccccctgcccgtgaacagcggccaggcccagagagtgctgtgccccagcaacagcagccagagaatccccctgcaggcccagaagctggtgagcagccacaagcccgtgcagaaccagaagcagaagcagctgcaggccaccagcgtgccccaccccgtgagcagacccctgaacaacacccagaagagcaagcagcccctgcccagcgcccccgagaacaaccccgaggaggagctggccagcaagcagaagaacgaggagagcaagaagagacagtgggccctggaggacttcgagatcggcagacccctgggcaagggcaagttcggcaacgtgtacctggccagagagaagcagagcaagttcatcctggccctgaaggtgctgttcaaggcccagctggagaaggccggcgtggagcaccagctgagaagagaggtggagatccagagccacctgagacaccccaacatcctgagactgtacggctacttccacgacgccaccagagtgtacctgatcctggagtacgcccccctgggcaccgtgtacagagagctgcagaagctgagcaagttcgacgagcagagaaccgccacctacatcaccgagctggccaacgccctgagctactgccacagcaagagagtgatccacagagacatcaagcccgagaacctgctgctgggcagcgccggcgagctgaagatcgccgacttcggctggagcgtgcacgcccccagcagcagaagaaccaccctgtgcggcaccctggactacctgccccccgagatgatcgagggcagaatgcacgacgagaaggtggacctgtggagcctgggcgtgctgtgctacgagttcctggtgggcaagccccccttcgaggccaacacctaccaggagacctacaagagaatcagcagagtgagaagaaactag

SEQ ID NO: 9461 - DNA, 1212 bp, Artificial Sequence; identical to SEQ ID NO: 9457
  Description of Artificial Sequence: Synthetic coding sequence

SEQ ID NO: 9462 - DNA, 1212 bp, Artificial Sequence; identical to SEQ ID NO: 9457
  Description of Artificial Sequence: Synthetic coding sequence

SEQ ID NO: 9463 - DNA, 1212 bp, Artificial Sequence; identical to SEQ ID NO: 9457
  Description of Artificial Sequence: Synthetic coding sequence

SEQ ID NO: 9464 - DNA, 1212 bp, Artificial Sequence; identical to SEQ ID NO: 9457
  Description of Artificial Sequence: Synthetic coding sequence

SEQ ID NO: 9465 - DNA, 1212 bp, Artificial Sequence; identical to SEQ ID NO: 9457
  Description of Artificial Sequence: Synthetic coding sequence

SEQ ID NO: 9466 - DNA, 570 bp, Artificial Sequence
  Description of Artificial Sequence: Synthetic coding sequence
atggacagaagcaaggagaactgcatcagcggccccgtgaaggccaccgcccccgtgggcggccccaagagagtgctggtgacccagcagttcccctgccagaaccccctgcccgtgaacagcggccaggcccagagagtgctgtgccccagcaacagcagccagagaatccccctgcaggcccagaagctggtgagcagccacaagcccgtgcagaaccagaagcagaagcagctgcaggccaccagcgtgccccaccccgtgagcagacccctgaacaacacccagaagagcaagcagcccctgcccagcgcccccgagaacaaccccgaggaggagctggccagcaagcagaagaacgaggagagcaagaagagacagtgggccctggaggacttcgagatcggcagacccctgggcaagggcaagttcggcaacgtgtacctggccagagagaagcagagcaagttcatcctggccctgaaggtgctgttcaaggcccagctggagaaggccggcgtggagcaccagctgagaagagaggtggagatccagagccacctgagatag

SEQ ID NO: 9467 - DNA, 444 bp, Artificial Sequence
  Description of Artificial Sequence: Synthetic coding sequence
atggacagaagcaaggagaactgcatcagcggccccgtgaaggccaccgcccccgtgggcggccccaagagagtgctggtgacccagcagttcccctgccagaaccccctgcccgtgaacagcggccaggcccagagagtgctgtgccccagcaacagcagccagagaatccccctgcaggcccagaagctggtgagcagccacaagcccgtgcagaaccagaagcagaagcagctgcaggccaccagcgtgccccaccccgtgagcagacccctgaacaacacccagaagagcaagcagcccctgcccagcgcccccgagaacaaccccgaggaggagctggccagcaagcagaagaacgaggagagcaagaagagacagtgggccctggaggacttcgagatcggcagacccctgggcaagggcaagttcggcaacgtgtag

SEQ ID NO: 9468 - DNA, 816 bp, Artificial Sequence
  Description of Artificial Sequence: Synthetic coding sequence
atggacagaagcaaggagaactgcatcagcggccccgtgaaggccaccgcccccgtgggcggccccaagagagtgctggtgacccagcagttcccctgccagaaccccctgcccgtgaacagcggccaggcccagagagtgctgtgccccagcaacagcagccagagaatccccctgcaggcccagaagctggtgagcagccacaagcccgtgcagaaccagaagcagaagcagctgcaggccaccagcgtgccccaccccgtgagcagacccctgaacaacacccagaagagcaagcagcccctgcccagcgcccccgagaacaaccccgaggaggagctggccagcaagcagaagaacgaggagagcaagaagagacagtgggccctggaggacttcgagatcggcagacccctgggcaagggcaagttcggcaacgtgtacctggccagagagaagcagagcaagttcatcctggccctgaaggtgctgttcaaggcccagctggagaaggccggcgtggagcaccagctgagaagagaggtggagatccagagccacctgagacaccccaacatcctgagactgtacggctacttccacgacgccaccagagtgtacctgatcctggagtacgcccccctgggcaccgtgtacagagagctgcagaagctgagcaagttcgacgagcagagaaccgccacctacatcaccgagctggccaacgccctgagctactgccacagcaagagagtgatccacagagacatcaagcccgagaacctgctgctgggcagcgccggcgagctgaagtag

SEQ ID NO: 9469 - DNA, 240 bp, Artificial Sequence
  Description of Artificial Sequence: Synthetic coding sequence
atggacagaagcaaggagaactgcatcagcggccccgtgaaggccaccgcccccgtgggcggccccaagagagtgctggtgacccagcagttcccctgccagaaccccctgcccgtgaacagcggccaggcccagagagtgctgtgccccagcaacagcagccagagaatccccctgcaggcccagaagctggtgagcagccacaagcccgtgcagaaccagaagcagaagcagctgtag

SEQ ID NO: 9470 - DNA, 321 bp, Artificial Sequence
  Description of Artificial Sequence: Synthetic coding sequence
atggacagaagcaaggagaactgcatcagcggccccgtgaaggccaccgcccccgtgggcggccccaagagagtgctggtgacccagcagttcccctgccagaaccccctgcccgtgaacagcggccaggcccagagagtgctgtgccccagcaacagcagccagagaatccccctgcaggcccagaagctggtgagcagccacaagcccgtgcagaaccagaagcagaagcagctgcaggccaccagcgtgccccaccccgtgagcagacccctgaacaacacccagaagagcaagcagcccctgcccagcgccccctag

SEQ ID NO: 9471 - DNA, 1035 bp, Artificial Sequence
  Description of Artificial Sequence: Synthetic coding sequence
atggcccagaaggagaacagctacccctggccctacggcagacagaccgcccccagcggcctgagcaccctgccccagagagtgctgagaaaggagcccgtgacccccagcgccctggtgctgatgagcagaagcaacgtgcagcccaccgccgcccccggccagaaggtgatggagaacagcagcggcacccccgacatcctgaccagacacttcaccatcgacgacttcgagatcggcagacccctgggcaagggcaagttcggcaacgtgtacctggccagagagaagaagagccacttcatcgtggccctgaaggtgctgttcaagagccagatcgagaaggagggcgtggagcaccagctgagaagagagatcgagatccaggcccacctgcaccaccccaacatcctgagactgtacaactacttctacgacagaagaagaatctacctgatcctggagtacgcccccagaggcgagctgtacaaggagctgcagaagagctgcaccttcgacgagcagagaaccgccaccatcatggaggagctggccgacgccctgatgtactgccacggcaagaaggtgatccacagagacatcaagcccgagaacctgctgctgggcctgaagggcgagctgaagatcgccgacttcggctggagcgtgcacgcccccagcctgagaagaaagaccatgtgcggcaccctggactacctgccccccgagatgatcgagggcagaatgcacaacgagaaggtggacctgtggtgcatcggcgtgctgtgctacgagctgctggtgggcaacccccccttcgagagcgccagccacaacgagacctacagaagaatcgtgaaggtggacctgaagttccccgccagcgtgcccatgggcgcccaggacctgatcagcaagctgctgagacacaaccccagcgagagactgcccctggcccaggtgagcgcccacccctgggtgagagccaacagcagaagagtgctgccccccagcgccctgcagagcgtggcctag

SEQ ID NO: 9472 - DNA, 912 bp, Artificial Sequence
  Description of Artificial Sequence: Synthetic coding sequence
atgagcagaagcaacgtgcagcccaccgccgcccccggccagaaggtgatggagaacagcagcggcacccccgacatcctgaccagacacttcaccatcgacgacttcgagatcggcagacccctgggcaagggcaagttcggcaacgtgtacctggccagagagaagaagagccacttcatcgtggccctgaaggtgctgttcaagagccagatcgagaaggagggcgtggagcaccagctgagaagagagatcgagatccaggcccacctgcaccaccccaacatcctgagactgtacaactacttctacgacagaagaagaatctacctgatcctggagtacgcccccagaggcgagctgtacaaggagctgcagaagagctgcaccttcgacgagcagagaaccgccaccatcatggaggagctggccgacgccctgatgtactgccacggcaagaaggtgatccacagagacatcaagcccgagaacctgctgctgggcctgaagggcgagctgaagatcgccgacttcggctggagcgtgcacgcccccagcctgagaagaaagaccatgtgcggcaccctggactacctgccccccgagatgatcgagggcagaatgcacaacgagaaggtggacctgtggtgcatcggcgtgctgtgctacgagctgctggtgggcaacccccccttcgagagcgccagccacaacgagacctacagaagaatcgtgaaggtggacctgaagttccccgccagcgtgcccatgggcgcccaggacctgatcagcaagctgctgagacacaaccccagcgagagactgcccctggcccaggtgagcgcccacccctgggtgagagccaacagcagaagagtgctgccccccagcgccctgcagagcgtggcctag

SEQ ID NO: 9473 - DNA, 1035 bp, Artificial Sequence; identical to SEQ ID NO: 9471
  Description of Artificial Sequence: Synthetic coding sequence

SEQ ID NO: 9474 - DNA, 930 bp, Artificial Sequence
  Description of Artificial Sequence: Synthetic coding sequence
atgagcagccccagagccgtggtgcagctgggcaaggcccagcccgccggcgaggagctggccaccgccaaccagaccgcccagcagcccagcagccccgccatgagaagactgaccgtggacgacttcgagatcggcagacccctgggcaagggcaagttcggcaacgtgtacctggccagactgaaggagagccacttcatcgtggccctgaaggtgctgttcaagagccagatcgagaaggagggcctggagcaccagctgagaagagagatcgagatccaggcccacctgcagcaccccaacatcctgagactgtacaactacttccacgacgccagaagagtgtacctgatcctggagtacgcccccagaggcgagctgtacaaggagctgcagaagagcgagaagctggacgagcagagaaccgccaccatcatcgaggagctggccgacgccctgacctactgccacgacaagaaggtgatccacagagacatcaagcccgagaacctgctgctgggcttcagaggcgaggtgaagatcgccgacttcggctggagcgtgcacacccccagcctgagaagaaagaccatgtgcggcaccctggactacctgccccccgagatgatcgagggcagaacctacgacgagaaggtggacctgtggtgcatcggcgtgctgtgctacgagctgctggtgggctacccccccttcgagagcgccagccacagcgagacctacagaagaatcctgaaggtggacgtgagattccccctgagcatgcccctgggcgccagagacctgatcagcagactgctgagataccagcccctggagagactgcccctggcccagatcctgaagcacccctgggtgcaggcccacagcagaagagtgctgcccccctgcgcccagatggccagctag

SEQ ID NO: 9475 - DNA, 873 bp, Artificial Sequence
  Description of Artificial Sequence: Synthetic coding sequence
atggccaccgccaaccagaccgcccagcagcccagcagccccgccatgagaagactgaccgtggacgacttcgagatcggcagacccctgggcaagggcaagttcggcaacgtgtacctggccagactgaaggagagccacttcatcgtggccctgaaggtgctgttcaagagccagatcgagaaggagggcctggagcaccagctgagaagagagatcgagatccaggcccacctgcagcaccccaacatcctgagactgtacaactacttccacgacgccagaagagtgtacctgatcctggagtacgcccccagaggcgagctgtacaaggagctgcagaagagcgagaagctggacgagcagagaaccgccaccatcatcgaggagctggccgacgccctgacctactgccacgacaagaaggtgatccacagagacatcaagcccgagaacctgctgctgggcttcagaggcgaggtgaagatcgccgacttcggctggagcgtgcacacccccagcctgagaagaaagaccatgtgcggcaccctggactacctgccccccgagatgatcgagggcagaacctacgacgagaaggtggacctgtggtgcatcggcgtgctgtgctacgagctgctggtgggctacccccccttcgagagcgccagccacagcgagacctacagaagaatcctgaaggtggacgtgagattccccctgagcatgcccctgggcgccagagacctgatcagcagactgctgagataccagcccctggagagactgcccctggcccagatcctgaagcacccctgggtgcaggcccacagcagaagagtgctgcccccctgcgcccagatggccagctag

SEQ ID NO: 9476 - DNA, 828 bp, Artificial Sequence
  Description of Artificial Sequence: Synthetic coding sequence
atgagaagactgaccgtggacgacttcgagatcggcagacccctgggcaagggcaagttcggcaacgtgtacctggccagactgaaggagagccacttcatcgtggccctgaaggtgctgttcaagagccagatcgagaaggagggcctggagcaccagctgagaagagagatcgagatccaggcccacctgcagcaccccaacatcctgagactgtacaactacttccacgacgccagaagagtgtacctgatcctggagtacgcccccagaggcgagctgtacaaggagctgcagaagagcgagaagctggacgagcagagaaccgccaccatcatcgaggagctggccgacgccctgacctactgccacgacaagaaggtgatccacagagacatcaagcccgagaacctgctgctgggcttcagaggcgaggtgaagatcgccgacttcggctggagcgtgcacacccccagcctgagaagaaagaccatgtgcggcaccctggactacctgccccccgagatgatcgagggcagaacctacgacgagaaggtggacctgtggtgcatcggcgtgctgtgctacgagctgctggtgggctacccccccttcgagagcgccagccacagcgagacctacagaagaatcctgaaggtggacgtgagattccccctgagcatgcccctgggcgccagagacctgatcagcagactgctgagataccagcccctggagagactgcccctggcccagatcctgaagcacccctgggtgcaggcccacagcagaagagtgctgcccccctgcgcccagatggccagctag

SEQ ID NO: 9477 - DNA, 2589 bp, Artificial Sequence
  Description of Artificial Sequence: Synthetic coding sequence
atgaacatccaggagcagggcttccccctggacctgggcgccagcttcaccgaggacgcccccagaccccccgtgcccggcgaggagggcgagctggtgagcaccgaccccagacccgccagctacagcttctgcagcggcaagggcgtgggcatcaagggcgagaccagcaccgccacccccagaagaagcgacctggacctgggctacgagcccgagggcagcgccagccccacccccccctacctgaagtgggccgagagcctgcacagcctgctggacgaccaggacggcatcagcctgttcagaaccttcctgaagcaggagggctgcgccgacctgctggacttctggttcgcctgcaccggcttcagaaagctggagccctgcgacagcaacgaggagaagagactgaagctggccagagccatctacagaaagtacatcctggacaacaacggcatcgtgagcagacagaccaagcccgccaccaagagcttcatcaagggctgcatcatgaagcagctgatcgaccccgccatgttcgaccaggcccagaccgagatccaggccaccatggaggagaacacctaccccagcttcctgaagagcgacatctacctggagtacaccagaaccggcagcgagagccccaaggtgtgcagcgaccagagcagcggcagcggcaccggcaagggcatcagcggctacctgcccaccctgaacgaggacgaggagtggaagtgcgaccaggacatggacgaggacgacggcagagacgccgccccccccggcagactgccccagaagctgctgctggagaccgccgcccccagagtgagcagcagcagaagatacagcgagggcagagagttcagatacggcagctggagagagcccgtgaacccctactacgtgaacgccggctacgccctggcccccgccaccagcgccaacgacagcgagcagcagagcctgagcagcgacgccgacaccctgagcctgaccgacagcagcgtggacggcatccccccctacagaatcagaaagcagcacagaagagagatgcaggagagcgtgcaggtgaacggcagagtgcccctgccccacatccccagaacctacagagtgcccaaggaggtgagagtggagccccagaagttcgccgaggagctgatccacagactggaggccgtgcagagaaccagagaggccgaggagaagctggaggagagactgaagagagtgagaatggaggaggagggcgaggacggcgaccccagcagcggcccccccggcccctgccacaagctgccccccgcccccgcctggcaccacttcccccccagatgcgtggacatgggctgcgccggcctgagagacgcccacgaggagaaccccgagagcatcctggacgagcacgtgcagagagtgctgagaacccccggcagacagagccccggccccggccacagaagccccgacagcggccacgtggccaagatgcccgtggccctgggcggcgccgccagcggccacggcaagcacgtgcccaagagcggcgccaagctggacgccgccggcctgcaccaccacagacacgtgcaccaccacgtgcaccacagcaccgccagacccaaggagcaggtggaggccgaggccaccagaagagcccagagcagcttcgcctggggcctggagccccacagccacggcgccagaagcagaggctacagcgagagcgtgggcgccgcccccaacgccagcgacggcctggcccacagcggcaaggtgggcgtggcctgcaagagaaacgccaagaaggccgagagcggcaagagcgccagcaccgaggtgcccggcgccagcgaggacgccgagaagaaccagaagatcatgcagtggatcatcgagggcgagaaggagatcagcagacacagaagaaccggccacggcagcagcggcaccagaaagccccagccccacgagaacagcagacccctgagcctggagcacccctgggccggcccccagctgagaaccagcgtgcagcccagccacctgttcatccaggaccccaccatgcccccccaccccgcccccaaccccctgacccagctggaggaggccagaagaagactggaggaggaggagaagagagccagcagagcccccagcaagcagagatacgtgcaggaggtgatgagaagaggcagagcctgcgtgagacccgcctgcgcccccgtgctgcacgtggtgcccgccgtgagcgacatggagctgagcgagaccgagaccagaagccagagaaaggtgggcggcggcagcgcccagccctgcgacagcatcgtggtggcctactacttctgcggcgagcccatcccctacagaaccctggtgagaggcagagccgtgaccctgggccagttcaaggagctgctgaccaagaagggcagctacagatactacttcaagaaggtgagcgacgagttcgactgcggcgtggtgttcgaggaggtgagagaggacgaggccgtgctgcccgtgttcgaggagaagatcatcggcaaggtggagaaggtggactag

SEQ ID NO: 9478 - DNA, 2481 bp, Artificial Sequence
  Description of Artificial Sequence: Synthetic coding sequence
atgaacatccaggagcagggcttccccctggacctgggcgccagcttcaccgaggacgcccccagaccccccgtgcccggcgaggagggcgagctggtgagcaccgaccccagacccgccagctacagcttctgcagcggcaagggcgtgggcatcaagggcgagaccagcaccgccacccccagaagaagcgacctggacctgggctacgagcccgagggcagcgccagccccacccccccctacctgaagtgggccgagagcctgcacagcctgctggacgaccaggacggcatcagcctgttcagaaccttcctgaagcaggagggctgcgccgacctgctggacttctggttcgcctgcaccggcttcagaaagctggagccctgcgacagcaacgaggagaagagactgaagctggccagagccatctacagaaagtacatcctggacaacaacggcatcgtgagcagacagaccaagcccgccaccaagagcttcatcaagggctgcatcatgaagcagctgatcgaccccgccatgttcgaccaggcccagaccgagatccaggccaccatggaggagaacacctaccccagcttcctgaagagcgacatctacctggagtacaccagaaccggcagcgagagccccaaggtgtgcagcgaccagagcagcggcagcggcaccggcaagggcatcagcggctacctgcccaccctgaacgaggacgaggagtggaagtgcgaccaggacatggacgaggacgacggcagagacgccgccccccccggcagactgccccagaagctgctgctggagaccgccgcccccagagtgagcagcagcagaagatacagcgagggcagagagttcagatacggcagctggagagagcccgtgaacccctactacgtgaacgccggctacgccctggcccccgccaccagcgccaacgacagcgagcagcagagcctgagcagcgacgccgacaccctgagcctgaccgacagcagcgtggacggcatccccccctacagaatcagaaagcagcacagaagagagatgcaggagagcgtgcaggtgaacggcagagtgcccctgccccacatccccagaacctacagagtgcccaaggaggtgagagtggagccccagaagttcgccgaggagctgatccacagactggaggccgtgcagagaaccagagaggccgaggagaagctggaggagagactgaagagagtgagaatggaggaggagggcgaggacggcgaccccagcagcggcccccccggcccctgccacaagctgccccccgcccccgcctggcaccacttcccccccagatgcgtggacatgggctgcgccggcctgagagacgcccacgaggagaaccccgagagcatcctggacgagcacgtgcagagagtgctgagaacccccggcagacagagccccggccccggccacagaagccccgacagcggccacgtggccaagatgcccgtggccctgggcggcgccgccagcggccacggcaagcacgtgcccaagagcggcgccaagctggacgccgccggcctgcaccaccacagacacgtgcaccaccacgtgcaccacagcaccgccagacccaaggagcaggtggaggccgaggccaccagaagagcccagagcagcttcgcctggggcctggagccccacagccacggcgccagaagcagaggctacagcgagagcgtgggcgccgcccccaacgccagcgacggcctggcccacagcggcaaggtgggcgtggcctgcaagagaaacgccaagaaggccgagagcggcaagagcgccagcaccgaggtgcccggcgccagcgaggacgccgagaagaaccagaagatcatgcagtggatcatcgagggcgagaaggagatcagcagacacagaagaaccggccacggcagcagcggcaccagaaagccccagccccacgagaacagcagacccctgagcctggagcacccctgggccggcccccagctgagaaccagcgtgcagcccagccacctgttcatccaggaccccaccatgcccccccaccccgcccccaaccccctgacccagctggaggaggccagaagaagactggaggaggaggagaagagagccagcagagcccccagcaagcagagaaccagaagccagagaaaggtgggcggcggcagcgcccagccctgcgacagcatcgtggtggcctactacttctgcggcgagcccatcccctacagaaccctggtgagaggcagagccgtgaccctgggccagttcaaggagctgctgaccaagaagggcagctacagatactacttcaagaaggtgagcgacgagttcgactgcggcgtggtgttcgaggaggtgagagaggacgaggccgtgctgcccgtgttcgaggagaagatcatcggcaaggtggagaaggtggactag

SEQ ID NO: 9479 - DNA, 309 bp, Artificial Sequence
  Description of Artificial Sequence: Synthetic coding sequence
tgactggaggaggaggagaagagagccagcagagcccccagcaagcagagaaccagaagccagagaaaggtgggcggcggcagcgcccagccctgcgacagcatcgtggtggcctactacttctgcggcgagcccatcccctacagaaccctggtgagaggcagagccgtgaccctgggccagttcaaggagctgctgaccaagaagggcagctacagaccccccagccacctgagatgctgcctgctgaccgccctgctgaccagcgtgctgcagatcctgctgcaggagagcgagagaagagtgtag

SEQ ID NO: 9480 - DNA, 1824 bp, Artificial Sequence
  Description of Artificial Sequence: Synthetic coding sequence
atggtgtgcaccagaaagaccaagaccctggtgagcacctgcgtgatcctgagcggcatgaccaacatcatctgcctgctgtacgtgggctgggtgaccaactacatcgccagcgtgtacgtgagaggccaggagcccgcccccgacaagaagctggaggaggacaagggcgacaccctgaagatcatcgagagactggaccacctggagaacgtgatcaagcagcacatccaggaggcccccgccaagcccgaggaggccgaggccgagcccttcaccgacagcagcctgttcgcccactggggccaggagctgagccccgagggcagaagagtggccctgaagcagttccagtactacggctacaacgcctacctgagcgacagactgcccctggacagacccctgcccgacctgagacccagcggctgcagaaacctgagcttccccgacagcctgcccgaggtgagcatcgtgttcatcttcgtgaacgaggccctgagcgtgctgctgagaagcatccacagcgccatggagagaacccccccccacctgctgaaggagatcatcctggtggacgacaacagcagcaacgaggagctgaaggagaagctgaccgagtacgtggacaaggtgaacagccagaagcccggcttcatcaaggtggtgagacacagcaagcaggagggcctgatcagaagcagagtgagcggctggagagccgccaccgcccccgtggtggccctgttcgacgcccacgtggagttcaacgtgggctgggccgagcccgtgctgaccagaatcaaggagaacagaaagagaatcatcagccccagcttcgacaacatcaagtacgacaacttcgagatcgaggagtaccccctggccgcccagggcttcgactgggagctgtggtgcagatacctgaacccccccaaggcctggtggaagctggagaacagcaccgcccccatcagaagccccgccctgatcggctgcttcatcgtggacagacagtacttccaggagatcggcctgctggacgagggcatggaggtgtacggcggcgagaacgtggagctgggcatcagagtgtggcagtgcggcggcagcgtggaggtgctgccctgcagcagaatcgcccacatcgagagagcccacaagccctacaccgaggacctgaccgcccacgtgagaagaaacgccctgagagtggccgaggtgtggatggacgagttcaagagccacgtgtacatggcctggaacatcccccaggaggacagcggcatcgacatcggcgacatcaccgccagaaaggccctgagaaagcagctgcagtgcaagaccttcagatggtacctggtgagcgtgtaccccgagatgagaatgtacagcgacatcatcgcctacggcgtgctgcagaacagcctgaagaccgacctgtgcctggaccagggccccgacaccgagaacgtgcccatcatgtacatctgccacggcatgaccccccagaacgtgtactacaccagcagccagcagatccacgtgggcatcctgagccccaccgtggacgacgacgacaacagatgcctggtggacgtgaacagcagacccagactgatcgagtgcagctacgccaaggccaagagaatgaagctgcactggcagttcagccagggcggccccatccagaacagaaagagcaagagatgcctggagctgcaggagaacagcgacctggagttcggcttccagctggtgctgcagaagtgcagcggccagcactggagcatcaccaacgtgctgagaagcctggccagctag

SEQ ID NO: 9481 - DNA, 1710 bp, Artificial Sequence
  Description of Artificial Sequence: Synthetic coding sequence
atgagcacctacagcaccttccccgccggcgtgcccgtgagcgagagaagcctggccagagccggcttctactacaccggcgtgaacgacaaggtgaagtgcttctgctgcggcctgatgctggacaactggaagctgggcgacagccccatccagaagcacaagcagctgtaccccagctgcagcttcatccagaacctggtgagcgccagcctgggcagcaccagcaagaacaccagccccatgagaaacagcttcgcccacagcctgagccccaccctggagcacagcagcctgttcagcggcagctacagcagcctgagccccaaccccctgaacagcagagccgtggaggacatcagcagcagcagaaccaacccctacagctacgccatgagcaccgaggaggccagattcctgacctaccacatgtggcccctgaccttcctgagccccagcgagctggccagagccggcttctactacatcggccccggcgacagagtggcctgcttcgcctgcggcggcaagctgagcaactgggagcccaaggacgacgccatgagcgagcacagaagacacttccccaactgccccttcctggagaacagcctggagaccctgagattcagcatcagcaacctgagcatgcagacccacgccgccagaatgagaaccttcatgtactggcccagcagcgtgcccgtgcagcccgagcagctggccagcgccggcttctactacgtgggcagaaacgacgacgtgaagtgcttctgctgcgacggcggcctgagatgctgggagagcggcgacgacccctgggtggagcacgccaagtggttccccagatgcgagttcctgatcagaatgaagggccaggagttcgtggacgagatccagggcagatacccccacctgctggagcagctgctgagcaccagcgacaccaccggcgaggagaacgccgacccccccatcatccacttcggccccggcgagagcagcagcgaggacgccgtgatgatgaacacccccgtggtgaagagcgccctggagatgggcttcaacagagacctggtgaagcagaccgtgcagagcaagatcctgaccaccggcgagaactacaagaccgtgaacgacatcgtgagcgccctgctgaacgccgaggacgagaagagagaggaggagaaggagaagcaggccgaggagatggccagcgacgacctgagcctgatcagaaagaacagaatggccctgttccagcagctgacctgcgtgctgcccatcctggacaacctgctgaaggccaacgtgatcaacaagcaggagcacgacatcatcaagcagaagacccagatccccctgcaggccagagagctgatcgacaccatcctggtgaagggcaacgccgccgccaacatcttcaagaactgcctgaaggagatcgacagcaccctgtacaagaacctgttcgtggacaagaacatgaagtacatccccaccgaggacgtgagcggcctgagcctggaggagcagctgagaagactgcaggaggagagaacctgcaaggtgtgcatggacaaggaggtgagcgtggtgttcatcccctgcggccacctggtggtgtgccaggagtgcgcccccagcctgagaaagtgccccatctgcagaggcatcatcaagggcaccgtgagaaccttcctgagctag

SEQ ID NO: 9482 - DNA, 1794 bp, Artificial Sequence
  Description of Artificial Sequence: Synthetic coding sequence
atggaggacagcaccatcctgagcgactggaccaacagcaacaagcagaagatgaagtacgacttcagctgcgagctgtacagaatgagcacctacagcaccttccccgccggcgtgcccgtgagcgagagaagcctggccagagccggcttctactacaccggcgtgaacgacaaggtgaagtgcttctgctgcggcctgatgctggacaactggaagctgggcgacagccccatccagaagcacaagcagctgtaccccagctgcagcttcatccagaacctggtgagcgccagcctgggcagcaccagcaagaacaccagccccatgagaaacagcttcgcccacagcctgagccccaccctggagcacagcagcctgttcagcggcagctacagcagcctgagccccaaccccctgaacagcagagccgtggaggacatcagcagcagcagaaccaacccctacagctacgccatgagcaccgaggaggccagattcctgacctaccacatgtggcccctgaccttcctgagccccagcgagctggccagagccggcttctactacatcggccccggcgacagagtggcctgcttcgcctgcggcggcaagctgagcaactgggagcccaaggacgacgccatgagcgagcacagaagacacttccccaactgccccttcctggagaacagcctggagaccctgagattcagcatcagcaacctgagcatgcagacccacgccgccagaatgagaaccttcatgtactggcccagcagcgtgcccgtgcagcccgagcagctggccagcgccggcttctactacgtgggcagaaacgacgacgtgaagtgcttctgctgcgacggcggcctgagatgctgggagagcggcgacgacccctgggtggagcacgccaagtggttccccagatgcgagttcctgatcagaatgaagggccaggagttcgtggacgagatccagggcagatacccccacctgctggagcagctgctgagcaccagcgacaccaccggcgaggagaacgccgacccccccatcatccacttcggccccggcgagagcagcagcgaggacgccgtgatgatgaacacccccgtggtgaagagcgccctggagatgggcttcaacagagacctggtgaagcagaccgtgcagagcaagatcctgaccaccggcgagaactacaagaccgtgaacgacatcgtgagcgccctgctgaacgccgaggacgagaagagagaggaggagaaggagaagcaggccgaggagatggccagcgacgacctgagcctgatcagaaagaacagaatggccctgttccagcagctgacctgcgtgctgcccatcctggacaacctgctgaaggccaacgtgatcaacaagcaggagcacgacatcatcaagcagaagacccagatccccctgcaggccagagagctgatcgacaccatcctggtgaagggcaacgccgccgccaacatcttcaagaactgcctgaaggagatcgacagcaccctgtacaagaacctgttcgtggacaagaacatgaagtacatccccaccgaggacgtgagcggcctgagcctggaggagcagctgagaagactgcaggaggagagaacctgcaaggtgtgcatggacaaggaggtgagcgtggtgttcatcccctgcggccacctggtggtgtgccaggagtgcgcccccagcctgagaaagtgccccatctgcagaggcatcatcaagggcaccgtgagaaccttcctgagctag

SEQ ID NO: 9483 - DNA, 1605 bp, Artificial Sequence
  Description of Artificial Sequence: Synthetic coding sequence
atgcacaagaccgccagccagagactgttccccggccccagctaccagaacatcaagagcatcatggaggacagcaccatcctgagcgactggaccaacagcaacaagcagaagatgaagtacgacttcagctgcgagctgtacagaatgagcacctacagcaccttccccgccggcgtgcccgtgagcgagagaagcctggccagagccggcttctactacaccggcgtgaacgacaaggtgaagtgcttctgctgcggcctgatgctggacaactggaagctgggcgacagccccatccagaagcacaagcagctgtaccccagctgcagcttcatccagaacctggtgagcgccagcctgggcagcaccagcaagaacaccagccccatgagaaacagcttcgcccacagcctgagccccaccctggagcacagcagcctgttcagcggcagctacagcagcctgagccccaaccccctgaacagcagagccgtggaggacatcagcagcagcagaaccaacccctacagctacgccatgagcaccgaggaggccagattcctgacctaccacatgtggcccctgaccttcctgagccccagcgagctggccagagccggcttctactacatcggccccggcgacagagtggcctgcttcgcctgcggcggcaagctgagcaactgggagcccaaggacgacgccatgagcgagcacagaagacacttccccaactgccccttcctggagaacagcctggagaccctgagattcagcatcagcaacctgagcatgcagacccacgccgccagaatgagaaccttcatgtactggcccagcagcgtgcccgtgcagcccgagcagctggccagcgccggcttctactacgtgggcagaaacgacgacgtgaagtgcttctgctgcgacggcggcctgagatgctgggagagcggcgacgacccctgggtggagcacgccaagtggttccccagatgcgagttcctgatcagaatgaagggccaggagttcgtggacgagatccagggcagatacccccacctgctggagcagctgctgagcaccagcgacaccaccggcgaggagaacgccgacccccccatcatccacttcggccccggcgagagcagcagcgaggacgccgtgatgatgaacacccccgtggtgaagagcgccctggagatgggcttcaacagagacctggtgaagcagaccgtgcagagcaagatcctgaccaccggcgagaactacaagaccgtgaacgacatcgtgagcgccctgctgaacgccgaggacgagaagagagaggaggagaaggagaagcaggccgaggagatggccagcgacgacctgagcctgatcagaaagaacagaatggccctgttccagcagctgacctgcgtgctgcccatcctggacaacctgctgaaggccaacgtgatcaacaagcaggagcacgacatcatcaagcagaagacccagatccccctgcaggccagagagctgatcgacaccatcctggtgaagggcaacgccgccgccaacatcttcaagaactgcctgaaggtgaagcagagattctag

SEQ ID NO: 9484 - DNA, 1815 bp, Artificial Sequence
  Description of Artificial Sequence: Synthetic coding sequence
atgaacatcgtggagaacagcatcttcctgagcaacctgatgaagagcgccaacaccttcgagctgaagtacgacctgagctgcgagctgtacagaatgagcacctacagcaccttccccgccggcgtgcccgtgagcgagagaagcctggccagagccggcttctactacaccggcgtgaacgacaaggtgaagtgcttctgctgcggcctgatgctggacaactggaagagaggcgacagccccaccgagaagcacaagaagctgtaccccagctgcagattcgtgcagagcctgaacagcgtgaacaacctggaggccaccagccagcccaccttccccagcagcgtgaccaacagcacccacagcctgctgcccggcaccgagaacagcggctacttcagaggcagctacagcaacagccccagcaaccccgtgaacagcagagccaaccaggacttcagcgccctgatgagaagcagctaccactgcgccatgaacaacgagaacgccagactgctgaccttccagacctggcccctgaccttcctgagccccaccgacctggccaaggccggcttctactacatcggccccggcgacagagtggcctgcttcgcctgcggcggcaagctgagcaactgggagcccaaggacaacgccatgagcgagcacctgagacacttccccaagtgccccttcatcgagaaccagctgcaggacaccagcagatacaccgtgagcaacctgagcatgcagacccacgccgccagattcaagaccttcttcaactggcccagcagcgtgctggtgaaccccgagcagctggccagcgccggcttctactacgtgggcaacagcgacgacgtgaagtgcttctgctgcgacggcggcctgagatgctgggagagcggcgacgacccctgggtgcagcacgccaagtggttccccagatgcgagtacctgatcagaatcaagggccaggagttcatcagacaggtgcaggccagctacccccacctgctggagcagctgctgagcaccagcgacagccccggcgacgagaacgccgagagcagcatcatccacttcgagcccggcgaggaccacagcgaggacgccatcatgatgaacacccccgtgatcaacgccgccgtggagatgggcttcagcagaagcctggtgaagcagaccgtgcagagaaagatcctggccaccggcgagaactacagactggtgaacgacctggtgctggacctgctgaacgccgaggacgagatcagagaggaggagagagagagagccaccgaggagaaggagagcaacgacctgctgctgatcagaaagaacagaatggccctgttccagcacctgacctgcgtgatccccatcctggacagcctgctgaccgccggcatcatcaacgagcaggagcacgacgtgatcaagcagaagacccagaccagcctgcaggccagagagctgatcgacaccatcctggtgaagggcaacatcgccgccaccgtgttcagaaacagcctgcaggaggccgaggccgtgctgtacgagcacctgttcgtgcagcaggacatcaagtacatccccaccgaggacgtgagcgacctgcccgtggaggagcagctgagaagactgcaggaggagagaacctgcaaggtgtgcatggacaaggaggtgagcatcgtgttcatcccctgcggccacctggtggtgtgcaaggactgcgcccccagcctgagaaagtgccccatctgcagaagcaccatcaagggcaccgtgagaaccttcctgagctag

SEQ ID NO: 9485 - DNA, 1815 bp, Artificial Sequence; identical to SEQ ID NO: 9484
  Description of Artificial Sequence: Synthetic coding sequence

SEQ ID NO: 9486 - DNA, 498 bp, Artificial Sequence
  Description of Artificial Sequence: Synthetic coding sequence
atgggcgcccccaccctgccccccgcctggcagcccttcctgaaggaccacagaatcagcaccttcaagaactggcccttcctggagggctgcgcctgcacccccgagagaatggccgaggccggcttcatccactgccccaccgagaacgagcccgacctggcccagtgcttcttctgcttcaaggagctggagggctgggagcccgacgacgaccccatcggccccggcaccgtggcctacgcctgcaacaccagcaccctgggcggcagaggcggcagaatcaccagagaggagcacaagaagcacagcagcggctgcgccttcctgagcgtgaagaagcagttcgaggagctgaccctgggcgagttcctgaagctggacagagagagagccaagaacaagatcgccaaggagaccaacaacaagaagaaggagttcgaggagaccgccgagaaggtgagaagagccatcgagcagctggccgccatggactag

SEQ ID NO: 9487 - DNA, 429 bp, Artificial Sequence
  Description of Artificial Sequence: Synthetic coding sequence
atgggcgcccccaccctgccccccgcctggcagcccttcctgaaggaccacagaatcagcaccttcaagaactggcccttcctggagggctgcgcctgcacccccgagagaatggccgaggccggcttcatccactgccccaccgagaacgagcccgacctggcccagtgcttcttctgcttcaaggagctggagggctgggagcccgacgacgaccccatcgaggagcacaagaagcacagcagcggctgcgccttcctgagcgtgaagaagcagttcgaggagctgaccctgggcgagttcctgaagctggacagagagagagccaagaacaagatcgccaaggagaccaacaacaagaagaaggagttcgaggagaccgccgagaaggtgagaagagccatcgagcagctggccgccatggactag

SEQ ID NO: 9488 - DNA, 414 bp, Artificial Sequence
  Description of Artificial Sequence: Synthetic coding sequence
atgggcgcccccaccctgccccccgcctggcagcccttcctgaaggaccacagaatcagcaccttcaagaactggcccttcctggagggctgcgcctgcacccccgagagaatggccgaggccggcttcatccactgccccaccgagaacgagcccgacctggcccagtgcttcttctgcttcaaggagctggagggctgggagcccgacgacgaccccatgcagagaaagcccaccatcagaagaaagaacctgagaaagctgagaagaaagtgcgccgtgcccagcagcagctggctgccctggatcgaggccagcggcagaagctgcctggtgcccgagtggctgcaccacttccagggcctgttccccggcgccaccagcctgcccgtgggccccctggccatgagctag

SEQ ID NO: 9489 - DNA, 432 bp, Artificial Sequence
  Description of Artificial Sequence: Synthetic coding sequence
atgggcgcccccaccctgccccccgcctggcagcccttcctgaaggaccacagaatcagcaccttcaagaactggcccttcctggagggctgcgcctgcacccccgagagaatggccgaggccggcttcatccactgccccaccgagaacgagcccgacctggcccagtgcttcttctgcttcaaggagctggagggctgggagcccgacgacgaccccatcggccccggcaccgtggcctacgcctgcaacaccagcaccctgggcggcagaggcggcagaatcaccagagaggagcacaagaagcacagcagcggctgcgccttcctgagcgtgaagaagcagttcgaggagctgaccctgggcgagttcctgaagctggacagagagagagccaagaacaagatcgagagagccctgctggccgagtag

SEQ ID NO: 9490 - DNA, 14574 bp, Artificial Sequence
  Description of Artificial Sequence: Synthetic coding sequence
atggtgaccggcggcggcgccgccccccccggcaccgtgaccgagcccctgcccagcgtgatcgtgctgagcgccggcagaaagatggccgccgccgccgccgccgccagcggccccggctgcagcagcgccgccggcgccggcgccgccggcgtgagcgagtggctggtgctgagagacggctgcatgcactgcgacgccgacggcctgcacagcctgagctaccaccccgccctgaacgccatcctggccgtgaccagcagaggcaccatcaaggtgatcgacggcaccagcggcgccaccctgcaggccagcgccctgagcgccaagcccggcggccaggtgaagtgccagtacatcagcgccgtggacaaggtgatcttcgtggacgactacgccgtgggctgcagaaaggacctgaacggcatcctgctgctggacaccgccctgcagacccccgtgagcaagcaggacgacgtggtgcagctggagctgcccgtgaccgaggcccagcagctgctgagcgcctgcctggagaaggtggacatcagcagcaccgagggctacgacctgttcatcacccagctgaaggacggcctgaagaacaccagccacgagaccgccgccaaccacaaggtggccaagtgggccaccgtgaccttccacctgccccaccacgtgctgaagagcatcgccagcgccatcgtgaacgagctgaagaagatcaaccagaacgtggccgccctgcccgtggccagcagcgtgatggacagactgagctacctgctgcccagcgccagacccgagctgggcgtgggccccggcagaagcgtggacagaagcctgatgtacagcgaggccaacagaagagagaccttcaccagctggccccacgtgggctacagatgggcccagcccgaccccatggcccaggccggcttctaccaccagcccgccagcagcggcgacgacagagccatgtgcttcacctgcagcgtgtgcctggtgtgctgggagcccaccgacgagccctggagcgagcacgagagacacagccccaactgccccttcgtgaagggcgagcacacccagaacgtgcccctgagcgtgaccctggccaccagccccgcccagttcccctgcaccgacggcaccgacagaatcagctgcttcggcagcggcagctgcccccacttcctggccgccgccaccaagagaggcaagatctgcatctgggacgtgagcaagctgatgaaggtgcacctgaagttcgagatcaacgcctacgaccccgccatcgtgcagcagctgatcctgagcggcgaccccagcagcggcgtggacagcagaagacccaccctggcctggctggaggacagcagcagctgcagcgacatccccaagctggagggcgacagcgacgacctgctggaggacagcgacagcgaggagcacagcagaagcgacagcgtgaccggccacaccagccagaaggaggccatggaggtgagcctggacatcaccgccctgagcatcctgcagcagcccgagaagctgcagtgggagatcgtggccaacgtgctggaggacaccgtgaaggacctggaggagctgggcgccaacccctgcctgaccaacagcaagagcgagaagaccaaggagaagcaccaggagcagcacaacatccccttcccctgcctgctggccggcggcctgctgacctacaagagccccgccaccagccccatcagcagcaacagccacagaagcctggacggcctgagcagaacccagggcgagagcatcagcgagcagggcagcaccgacaacgagagctgcaccaacagcgagctgaacagccccctggtgagaagaaccctgcccgtgctgctgctgtacagcatcaaggagagcgacgagaaggccggcaagatcttcagccagatgaacaacatcatgagcaagagcctgcacgacgacggcttcaccgtgccccagatcatcgagatggagctggacagccaggagcagctgctgctgcaggacccccccgtgacctacatccagcagttcgccgacgccgccgccaacctgaccagccccgacagcgagaagtggaacagcgtgttccccaagcccggcaccctggtgcagtgcctgagactgcccaagttcgccgaggaggagaacctgtgcatcgacagcatcaccccctgcgccgacggcatccacctgctggtgggcctgagaacctgccccgtggagagcctgagcgccatcaaccaggtggaggccctgaacaacctgaacaagctgaacagcgccctgtgcaacagaagaaagggcgagctggagagcaacctggccgtggtgaacggcgccaacatcagcgtgatccagcacgagagccccgccgacgtgcagacccccctgatcatccagcccgagcagagaaacgtgagcggcggctacctggtgctgtacaagatgaactacgccaccagaatcgtgaccctggaggaggagcccatcaagatccagcacatcaaggacccccaggacaccatcaccagcctgatcctgctgccccccgacatcctggacaacagagaggacgactgcgaggagcccatcgaggacatgcagctgaccagcaagaacggcttcgagagagagaagaccagcgacatcagcaccctgggccacctggtgatcaccacccagggcggctacgtgaagatcctggacctgagcaacttcgagatcctggccaaggtggagccccccaagaaggagggcaccgaggagcaggacaccttcgtgagcgtgatctactgcagcggcaccgacagactgtgcgcctgcaccaagggcggcgagctgcacttcctgcagatcggcggcacctgcgacgacatcgacgaggccgacatcctggtggacggcagcctgagcaagggcatcgagcccagcagcgagggcagcaagcccctgagcaaccccagcagccccggcatcagcggcgtggacctgctggtggaccagcccttcaccctggagatcctgaccagcctggtggagctgaccagattcgagaccctgacccccagattcagcgccaccgtgcccccctgctgggtggaggtgcagcaggagcagcagcagagaagacacccccagcacctgcaccagcagcaccacggcgacgccgcccagcacaccagaacctggaagctgcagaccgacagcaacagctgggacgagcacgtgttcgagctggtgctgcccaaggcctgcatggtgggccacgtggacttcaagttcgtgctgaacagcaacatcaccaacatcccccagatccaggtgaccctgctgaagaacaaggcccccggcctgggcaaggtgaacgccctgaacatcgaggtggagcagaacggcaagcccagcctggtggacctgaacgaggagatgcagcacatggacgtggaggagagccagtgcctgagactgtgccccttcctggaggaccacaaggaggacatcctgtgcggccccgtgtggctggccagcggcctggacctgagcggccacgccggcatgctgaccctgaccagccccaagctggtgaagggcatggccggcggcaagtacagaagcttcctgatccacgtgaaggccgtgaacgagagaggcaccgaggagatctgcaacggcggcatgagacccgtggtgagactgcccagcctgaagcaccagagcaacaagggctacagcctggccagcctgctggccaaggtggccgccggcaaggagaagagcagcaacgtgaagaacgagaacaccagcggcaccagaaagagcgagaacctgagaggctgcgacctgctgcaggaggtgagcgtgaccatcagaagattcaagaagaccagcatcagcaaggagagagtgcagagatgcgccatgctgcagttcagcgagttccacgagaagctggtgaacaccctgtgcagaaagaccgacgacggccagatcaccgagcacgcccagagcctggtgctggacaccctgtgctggctggccggcgtgcacagcaacggccccggcagcagcaaggagggcaacgagaacctgctgagcaagaccagaaagttcctgagcgacatcgtgagagtgtgcttcttcgaggccggcagaagcatcgcccacaagtgcgccagattcctggccctgtgcatcagcaacggcaagtgcgacccctgccagcccgccttcggccccgtgctgctgaaggccctgctggacaacatgagcttcctgcccgccgccaccaccggcggcagcgtgtactggtacttcgtgctgctgaactacgtgaaggacgaggacctggccggctgcagcaccgcctgcgccagcctgctgaccgccgtgagcagacagctgcaggacagactgacccccatggaggccctgctgcagaccagatacggcctgtacagcagccccttcgaccccgtgctgttcgacctggagatgagcggcagcagctgcaagaacgtgtacaacagcagcatcggcgtgcagagcgacgagatcgacctgagcgacgtgctgagcggcaacggcaaggtgagcagctgcaccgccgccgagggcagcttcaccagcctgaccggcctgctggaggtggagcccctgcacttcacctgcgtgagcaccagcgacggcaccagaatcgagagagacgacgccatgagcagcttcggcgtgacccccgccgtgggcggcctgagcagcggcaccgtgggcgaggccagcaccgccctgagcagcgccgcccaggtggccctgcagagcctgagccacgccatggccagcgccgagcagcagctgcaggtgctgcaggagaagcagcagcagctgctgaagctgcagcagcagaaggccaagctggaggccaagctgcaccagaccaccgccgccgccgccgccgccgccagcgccgtgggccccgtgcacaacagcgtgcccagcaaccccgtggccgcccccggcttcttcatccaccccagcgacgtgatcccccccacccccaagaccacccccctgttcatgaccccccccctgaccccccccaacgaggccgtgagcgtggtgatcaacgccgagctggcccagctgttccccggcagcgtgatcgacccccccgccgtgaacctggccgcccacaacaagaacagcaacaagagcagaatgaaccccctgggcagcggcctggccctggccatcagccacgccagccacttcctgcagccccccccccaccagagcatcatcatcgagagaatgcacagcggcgccagaagattcgtgaccctggacttcggcagacccatcctgctgaccgacgtgctgatccccacctgcggcgacctggccagcctgagcatcgacatctggaccctgggcgaggaggtggacggcagaagactggtggtggccaccgacatcagcacccacagcctgatcctgcacgacctgatccccccccccgtgtgcagattcatgaagatcaccgtgatcggcagatacggcagcaccaacgccagagccaagatccccctgggcttctactacggccacacctacatcctgccctgggagagcgagctgaagctgatgcacgaccccctgaagggcgagggcgagagcgccaaccagcccgagatcgaccagcacctggccatgatggtggccctgcaggaggacatccagtgcagatacaacctggcctgccacagactggagaccctgctgcagagcatcgacctgccccccctgaacagcgccaacaacgcccagtacttcctgagaaagcccgacaaggccgtggaggaggacagcagagtgttcagcgcctaccaggactgcatccagctgcagctgcagctgaacctggcccacaacgccgtgcagagactgaaggtggccctgggcgccagcagaaagatgctgagcgagaccagcaaccccgaggacctgatccagaccagcagcaccgagcagctgagaaccatcatcagatacctgctggacaccctgctgagcctgctgcacgccagcaacggccacagcgtgcccgccgtgctgcagagcaccttccacgcccaggcctgcgaggagctgttcaagcacctgtgcatcagcggcacccccaagatcagactgcacaccggcctgctgctggtgcagctgtgcggcggcgagagatggtggggccagttcctgagcaacgtgctgcaggagctgtacaacagcgagcagctgctgatcttcccccaggacagagtgttcatgctgctgagctgcatcggccagagaagcctgagcaacagcggcgtgctggagagcctgctgaacctgctggacaacctgctgagccccctgcagccccagctgcccatgcacagaagaaccgagggcgtgctggacatccccatgatcagctgggtggtgatgctggtgagcagactgctggactacgtggccaccgtggaggacgaggccgccgccgccaagaagcccctgaacggcaaccagtggagcttcatcaacaacaacctgcacacccagagcctgaacagaagcagcaagggcagcagcagcctggacagactgtacagcagaaagatcagaaagcagctggtgcaccacaagcagcagctgaacctgctgaaggccaagcagaaggccctggtggagcagatggagaaggagaagatccagagcaacaagggcagcagctacaagctgctggtggagcaggccaagctgaagcaggccaccagcaagcacttcaaggacctgatcagactgagaagaaccgccgagtggagcagaagcaacctggacaccgaggtgaccaccgccaaggagagccccgagatcgagcccctgcccttcaccctggcccacgagagatgcatcagcgtggtgcagaagctggtgctgttcctgctgagcatggacttcacctgccacgccgacctgctgctgttcgtgtgcaaggtgctggccagaatcgccaacgccaccagacccaccatccacctgtgcgagatcgtgaacgagccccagctggagagactgctgctgctgctggtgggcaccgacttcaacagaggcgacatcagctggggcggcgcctgggcccagtacagcctgacctgcatgctgcaggacatcctggccggcgagctgctggcccccgtggccgccgaggccatggaggagggcaccgtgggcgacgacgtgggcgccaccgccggcgacagcgacgacagcctgcagcagagcagcgtgcagctgctggagaccatcgacgagcccctgacccacgacatcaccggcgccccccccctgagcagcctggagaaggacaaggagatcgacctggagctgctgcaggacctgatggaggtggacatcgaccccctggacatcgacctggagaaggaccccctggccgccaaggtgttcaagcccatcagcagcacctggtacgactactggggcgccgactacggcacctacaactacaacccctacatcggcggcctgggcatccccgtggccaagccccccgccaacaccgagaagaacggcagccagaccgtgagcgtgagcgtgagccaggccctggacgccagactggaggtgggcctggagcagcaggccgagctgatgctgaagatgatgagcaccctggaggccgacagcatcctgcaggccctgaccaacaccagccccaccctgagccagagccccaccggcaccgacgacagcctgctgggcggcctgcaggccgccaaccagaccagccagctgatcatccagctgagcagcgtgcccatgctgaacgtgtgcttcaacaagctgttcagcatgctgcaggtgcaccacgtgcagctggagagcctgctgcagctgtggctgaccctgagcctgaacagcagcagcaccggcaacaaggagaacggcgccgacatcttcctgtacaacgccaacagaatccccgtgatcagcctgaaccaggccagcatcaccagcttcctgaccgtgctggcctggtaccccaacaccctgctgagaacctggtgcctggtgctgcacagcctgaccctgatgaccaacatgcagctgaacagcggcagcagcagcgccatcggcacccaggagagcaccgcccacctgctggtgagcgaccccaacctgatccacgtgctggtgaagttcctgagcggcaccagcccccacggcaccaaccagcacagcccccaggtgggccccaccgccacccaggccatgcaggagttcctgaccagactgcaggtgcacctgagcagcacctgcccccagatcttcagcgagttcctgctgaagctgatccacatcctgagcaccgagagaggcgccttccagaccggccagggccccctggacgcccaggtgaagctgctggagttcaccctggagcagaacttcgaggtggtgagcgtgagcaccatcagcgccgtgatcgagagcgtgaccttcctggtgcaccactacatcacctgcagcgacaaggtgatgagcagaagcggcagcgacagcagcgtgggcgccagagcctgcttcggcggcctgttcgccaacctgatcagacccggcgacgccaaggccgtgtgcggcgagatgaccagagaccagctgatgttcgacctgctgaagctggtgaacatcctggtgcagctgcccctgagcggcaacagagagtacagcgccagagtgagcgtgaccaccaacaccaccgacagcgtgagcgacgaggagaaggtgagcggcggcaaggacggcaacggcagcagcaccagcgtgcagggcagccccgcctacgtggccgacctggtgctggccaaccagcagatcatgagccagatcctgagcgccctgggcctgtgcaacagcagcgccatggccatgatcatcggcgccagcggcctgcacctgaccaagcacgagaacttccacggcggcctggacgccatcagcgtgggcgacggcctgttcaccatcctgaccaccctgagcaagaaggccagcaccgtgcacatgatgctgcagcccatcctgacctacatggcctgcggctacatgggcagacagggcagcctggccacctgccagctgagcgagcccctgctgtggttcatcctgagagtgctggacaccagcgacgccctgaaggccttccacgacatgggcggcgtgcagctgatctgcaacaacatggtgaccagcaccagagccatcgtgaacaccgccagaagcatggtgagcaccatcatgaagttcctggacagcggccccaacaaggccgtggacagcaccctgaagaccagaatcctggccagcgagcccgacaacgccgagggcatccacaacttcgcccccctgggcaccatcaccagcagcagccccaccgcccagcccgccgaggtgctgctgcaggccacccccccccacagaagagccagaagcgccgcctggagctacatcttcctgcccgaggaggcctggtgcgacctgaccatccacctgcccgccgccgtgctgctgaaggagatccacatccagccccacctggccagcctggccacctgccccagcagcgtgagcgtggaggtgagcgccgacggcgtgaacatgctgcccctgagcacccccgtggtgaccagcggcctgacctacatcaagatccagctggtgaaggccgaggtggccagcgccgtgtgcctgagactgcacagacccagagacgccagcaccctgggcctgagccagatcaagctgctgggcctgaccgccttcggcaccaccagcagcgccaccgtgaacaaccccttcctgcccagcgaggaccaggtgagcaagaccagcatcggctggctgagactgctgcaccactgcctgacccacatcagcgacctggagggcatgatggccagcgccgccgcccccaccgccaacctgctgcagacctgcgccgccctgctgatgagcccctactgcggcatgcacagccccaacatcgaggtggtgctggtgaagatcggcctgcagagcaccagaatcggcctgaagctgatcgacatcctgctgagaaactgcgccgccagcggcagcgaccccaccgacctgaacagccccctgctgttcggcagactgaacggcctgagcagcgacagcaccatcgacatcctgtaccagctgggcaccacccaggaccccggcaccaaggacagaatccaggccctgctgaagtgggtgagcgacagcgccagagtggccgccatgaagagaagcggcagaatgaactacatgtgccccaacagcagcaccgtggagtacggcctgctgatgcccagccccagccacctgcactgcgtggccgccatcctgtggcacagctacgagctgctggtggagtacgacctgcccgccctgctggaccaggagctgttcgagctgctgttcaactggagcatgagcctgccctgcaacatggtgctgaagaaggccgtggacagcctgctgtgcagcatgtgccacgtgcaccccaactacttcagcctgctgatgggctggatgggcatcacccccccccccgtgcagtgccaccacagactgagcatgaccgacgacagcaagaagcaggacctgagcagcagcctgaccgacgacagcaagaacgcccaggcccccctggccctgaccgagagccacctggccaccctggccagcagcagccagagccccgaggccatcaagcagctgctggacagcggcctgcccagcctgctggtgagaagcctggccagcttctgcttcagccacatcagcagcagcgagagcatcgcccagagcatcgacatcagccaggacaagctgagaagacaccacgtgccccagcagtgcaacaagatgcccatcaccgccgacctggtggcccccatcctgagattcctgaccgaggtgggcaacagccacatcatgaaggactggctgggcggcagcgaggtgaaccccctgtggaccgccctgctgttcctgctgtgccacagcggcagcaccagcggcagccacaacctgggcgcccagcagaccagcgccagaagcgccagcctgagcagcgccgccaccaccggcctgaccacccagcagagaaccgccatcgagaacgccaccgtggccttcttcctgcagtgcatcagctgccaccccaacaaccagaagctgatggcccaggtgctgtgcgagctgttccagaccagcccccagagaggcaacctgcccaccagcggcaacatcagcggcttcatcagaagactgttcctgcagctgatgctggaggacgagaaggtgaccatgttcctgcagagcccctgccccctgtacaagggcagaatcaacgccaccagccacgtgatccagcaccccatgtacggcgccggccacaagttcagaaccctgcacctgcccgtgagcaccaccctgagcgacgtgctggacagagtgagcgacacccccagcatcaccgccaagctgatcagcgagcagaaggacgacaaggagaagaagaaccacgaggagaaggagaaggtgaaggccgagaacggcttccaggacaactacagcgtggtggtggccagcggcctgaagagccagagcaagagagccgtgagcgccaccccccccagaccccccagcagaagaggcagaaccatccccgacaagatcggcagcaccagcggcgccgaggccgccaacaagatcatcaccgtgcccgtgttccacctgttccacaagctgctggccggccagcccctgcccgccgagatgaccctggcccagctgctgaccctgctgtacgacagaaagctgccccagggctacagaagcatcgacctgaccgtgaagctgggcagcagagtgatcaccgaccccagcctgagcaagaccgacagctacaagagactgcaccccgagaaggaccacggcgacctgctggccagctgccccgaggacgaggccctgacccccggcgacgagtgcatggacggcatcctggacgagagcctgctggagacctgccccatccagagccccctgcaggtgttcgccggcatgggcggcctggccctgatcgccgagagactgcccatgctgtaccccgaggtgatccagcaggtgagcgcccccgtggtgaccagcaccacccaggagaagcccaaggacagcgaccagttcgagtgggtgaccatcgagcagagcggcgagctggtgtacgaggcccccgagaccgtggccgccgagcccccccccatcaagagcgccgtgcagaccatgagccccatccccgcccacagcctggccgccttcggcctgttcctgagactgcccggctacgccgaggtgctgctgaaggagagaaagcacgcccagtgcctgctgagactggtgctgggcgtgaccgacgacggcgagggcagccacatcctgcagagccccagcgccaacgtgctgcccaccctgcccttccacgtgctgagaagcctgttcagcaccacccccctgaccaccgacgacggcgtgctgctgagaagaatggccctggagatcggcgccctgcacctgatcctggtgtgcctgagcgccctgagccaccacagccccagagtgcccaacagcagcgtgaaccagaccgagccccaggtgagcagcagccacaaccccaccagcaccgaggagcagcagctgtactgggccaagggcaccggcttcggcaccggcagcaccgccagcggctgggacgtggagcaggccctgaccaagcagagactggaggaggagcacgtgacctgcctgctgcaggtgctggccagctacatcaaccccgtgagcagcgccgtgaacggcgaggcccagagcagccacgagaccagaggccagaacagcaacgccctgcccagcgtgctgctggagctgctgagccagagctgcctgatccccgccatgagcagctacctgagaaacgacagcgtgctggacatggccagacacgtgcccctgtacagagccctgctggagctgctgagagccatcgccagctgcgccgccatggtgcccctgctgctgcccctgagcaccgagaacggcgaggaggaggaggagcagagcgagtgccagaccagcgtgggcaccctgctggccaagatgaagacctgcgtggacacctacaccaacagactgagaagcaagagagagaacgtgaagaccggcgtgaagcccgacgccagcgaccaggagcccgagggcctgaccctgctggtgcccgacatccagaagaccgccgagatcgtgtacgccgccaccaccagcctgagacaggccaaccaggagaagaagctgggcgagtacagcaagaaggccgccatgaagcccaagcccctgagcgtgctgaagagcctggaggagaagtacgtggccgtgatgaagaagctgcagttcgacaccttcgagatggtgagcgaggacgaggacggcaagctgggcttcaaggtgaactaccactacatgagccaggtgaagaacgccaacgacgccaacagcgccgccagagccagaagactggcccaggaggccgtgaccctgagcaccagcctgcccctgagcagcagcagcagcgtgttcgtgagatgcgacgaggagagactggacatcatgaaggtgctgatcaccggccccgccgacaccccctacgccaacggctgcttcgagttcgacgtgtacttcccccaggactaccccagcagcccccccctggtgaacctggagaccaccggcggccacagcgtgagattcaaccccaacctgtacaacgacggcaaggtgtgcctgagcatcctgaacacctggcacggcagacccgaggagaagtggaacccccagaccagcagcttcctgcaggtgctggtgagcgtgcagagcctgatcctggtggccgagccctacttcaacgagcccggctacgagagaagcagaggcacccccagcggcacccagagcagcagagagtacgacggcaacatcagacaggccaccgtgaagtgggccatgctggagcagatcagaaaccccagcccctgcttcaaggaggtgatccacaagcacttctacctgaagagagtggagatcatggcccagtgcgaggagtggatcgccgacatccagcagtacagcagcgacaagagagtgggcagaaccatgagccaccacgccgccgccctgaagagacacaccgcccagctgagagaggagctgctgaagctgccctgccccgagggcctggaccccgacaccgacgacgcccccgaggtgtgcagagccaccaccggcgccgaggagaccctgatgcacgaccaggtgaagcccagcagcagcaaggagctgcccagcgacttccagctgtag

SEQ ID NO: 9491 - DNA, 1566 bp, Artificial Sequence
  Description of Artificial Sequence: Synthetic coding sequence
atgagcctgagcagaagcgaggagatgcacagactgaccgagaacgtgtacaagaccatcatggagcagttcaaccccagcctgagaaacttcatcgccatgggcaagaactacgagaaggccctggccggcgtgacctacgccgccaagggctacttcgacgccctggtgaagatgggcgagctggccagcgagagccagggcagcaaggagctgggcgacgtgctgttccagatggccgaggtgcacagacagatccagaaccagctggaggagatgctgaagagcttccacaacgagctgctgacccagctggagcagaaggtggagctggacagcagatacctgagcgccgccctgaagaagtaccagaccgagcagagaagcaagggcgacgccctggacaagtgccaggccgagctgaagaagctgagaaagaagagccagggcagcaagaacccccagaagtacagcgacaaggagctgcagtacatcgacgccatcagcaacaagcagggcgagctggagaactacgtgagcgacggctacaagaccgccctgaccgaggagagaagaagattctgcttcctggtggagaagcagtgcgccgtggccaagaacagcgccgcctaccacagcaagggcaaggagctgctggcccagaagctgcccctgtggcagcaggcctgcgccgaccccagcaagatccccgagagagccgtgcagctgatgcagcaggtggccagcaacggcgccaccctgcccagcgccctgagcgccagcaagagcaacctggtgatcagcgaccccatccccggcgccaagcccctgcccgtgccccccgagctggcccccttcgtgggcagaatgagcgcccaggagagcacccccatcatgaacggcgtgaccggccccgacggcgaggactacagcccctgggccgacagaaaggccgcccagcccaagagcctgagccccccccagagccagagcaagctgagcgacagctacagcaacaccctgcccgtgagaaagagcgtgacccccaagaacagctacgccaccaccgagaacaagaccctgcccagaagcagcagcatggccgccggcctggagagaaacggcagaatgagagtgaaggccatcttcagccacgccgccggcgacaacagcaccctgctgagcttcaaggagggcgacctgatcaccctgctggtgcccgaggccagagacggctggcactacggcgagagcgagaagaccaagatgagaggctggttccccttcagctacaccagagtgctggacagcgacggcagcgacagactgcacatgagcctgcagcagggcaagagcagcagcaccggcaacctgctggacaaggacgacctggccatccccccccccgactacggcgccgccagcagagccttccccgcccagaccgccagcggcttcaagcagagaccctacagcgtggccgtgcccgccttcagccagggcctggacgactacggcgccagaagcatgagcagcggcagcggcaccctggtgagcaccgtgtag

SEQ ID NO: 9492 - DNA, 1659 bp, Artificial Sequence
  Description of Artificial Sequence: Synthetic coding sequence
atgagcctgagcagaagcgaggagatgcacagactgaccgagaacgtgtacaagaccatcatggagcagttcaaccccagcctgagaaacttcatcgccatgggcaagaactacgagaaggccctggccggcgtgacctacgccgccaagggctacttcgacgccctggtgaagatgggcgagctggccagcgagagccagggcagcaaggagctgggcgacgtgctgttccagatggccgaggtgcacagacagatccagaaccagctggaggagatgctgaagagcttccacaacgagctgctgacccagctggagcagaaggtggagctggacagcagatacctgagcgccgccctgaagaagtaccagaccgagcagagaagcaagggcgacgccctggacaagtgccaggccgagctgaagaagctgagaaagaagagccagggcagcaagaacccccagaagtacagcgacaaggagctgcagtacatcgacgccatcagcaacaagcagggcgagctggagaactacgtgagcgacggctacaagaccgccctgaccgaggagagaagaagattctgcttcctggtggagaagcagtgcgccgtggccaagaacagcgccgcctaccacagcaagggcaaggagctgctggcccagaagctgcccctgtggcagcaggcctgcgccgaccccagcaagatccccgagagagccgtgcagctgatgcagcaggtggccagcaacggcgccaccctgcccagcgccctgagcgccagcaagagcaacctggtgatcagcgaccccatccccggcgccaagcccctgcccgtgccccccgagctggcccccttcgtgggcagaatgagcgcccaggagagcacccccatcatgaacggcgtgaccggccccgacggcgaggactacagcccctgggccgacagaaaggccgcccagcccaagagcctgagccccccccagagccagagcaagctgagcgacagctacagcaacaccctgcccgtgagaaagagcgtgacccccaagaacagctacgccaccaccgagaacaagaccctgcccagaagcagcagcatggccgccggcctggagagaaacggcagaatgagagtgaaggccatcttcagccacgccgccggcgacaacagcaccctgctgagcttcaaggagggcgacctgatcaccctgctggtgcccgaggccagagacggctggcactacggcgagagcgagaagaccaagatgagaggctggttccccttcagctacaccagagtgctggacagcgacggcagcgacagactgcacatgagcctgcagcagggcaagagcagcagcaccggcaacctgctggacaaggacgacctggccatccccccccccgactacggcgccgccagcagagccttccccgcccagaccgccagcggcttcaagcagagaccctacagcgtggccgtgcccgccttcagccagggcctggacgactacggcgccagaagcatgagcagaaaccccttcgcccacgtgcagctgaagcccaccgtgaccaacgacagatgcgacctgagcgcccagggccccgagggcagagagcacggcgacggcagcgccagaaccctggccggcagatag

SEQ ID NO: 9493 - DNA, 1371 bp, Artificial Sequence
  Description of Artificial Sequence: Synthetic coding sequence
atggccgaggtgcacagacagatccagaaccagctggaggagatgctgaagagcttccacaacgagctgctgacccagctggagcagaaggtggagctggacagcagatacctgagcgccgccctgaagaagtaccagaccgagcagagaagcaagggcgacgccctggacaagtgccaggccgagctgaagaagctgagaaagaagagccagggcagcaagaacccccagaagtacagcgacaaggagctgcagtacatcgacgccatcagcaacaagcagggcgagctggagaactacgtgagcgacggctacaagaccgccctgaccgaggagagaagaagattctgcttcctggtggagaagcagtgcgccgtggccaagaacagcgccgcctaccacagcaagggcaaggagctgctggcccagaagctgcccctgtggcagcaggcctgcgccgaccccagcaagatccccgagagagccgtgcagctgatgcagcaggtggccagcaacggcgccaccctgcccagcgccctgagcgccagcaagagcaacctggtgatcagcgaccccatccccggcgccaagcccctgcccgtgccccccgagctggcccccttcgtgggcagaatgagcgcccaggagagcacccccatcatgaacggcgtgaccggccccgacggcgaggactacagcccctgggccgacagaaaggccgcccagcccaagagcctgagccccccccagagccagagcaagctgagcgacagctacagcaacaccctgcccgtgagaaagagcgtgacccccaagaacagctacgccaccaccgagaacaagaccctgcccagaagcagcagcatggccgccggcctggagagaaacggcagaatgagagtgaaggccatcttcagccacgccgccggcgacaacagcaccctgctgagcttcaaggagggcgacctgatcaccctgctggtgcccgaggccagagacggctggcactacggcgagagcgagaagaccaagatgagaggctggttccccttcagctacaccagagtgctggacagcgacggcagcgacagactgcacatgagcctgcagcagggcaagagcagcagcaccggcaacctgctggacaaggacgacctggccatccccccccccgactacggcgccgccagcagagccttccccgcccagaccgccagcggcttcaagcagagaccctacagcgtggccgtgcccgccttcagccagggcctggacgactacggcgccagaagcatgagcagaaaccccttcgcccacgtgcagctgaagcccaccgtgaccaacgacagaagcgcccccctgctgagctag

SEQ ID NO: 9494 - DNA, 1128 bp, Artificial Sequence
  Description of Artificial Sequence: Synthetic coding sequence
atgctgctgcccgagggccagagacagagagccctgggcttcggcaccgtgaccagcacctacagccccgtgggccagtacatcgacgccatcagcaacaagcagggcgagctggagaactacgtgagcgacggctacaagaccgccctgaccgaggagagaagaagattctgcttcctggtggagaagcagtgcgccgtggccaagaacagcgccgcctaccacagcaagggcaaggagctgctggcccagaagctgcccctgtggcagcaggcctgcgccgaccccagcaagatccccgagagagccgtgcagctgatgcagcaggtggccagcaacggcgccaccctgcccagcgccctgagcgccagcaagagcaacctggtgatcagcgaccccatccccggcgccaagcccctgcccgtgccccccgagctggcccccttcgtgggcagaatgagcgcccaggagagcacccccatcatgaacggcgtgaccggccccgacggcgaggactacagcccctgggccgacagaaaggccgcccagcccaagagcctgagccccccccagagccagagcaagctgagcgacagctacagcaacaccctgcccgtgagaaagagcgtgacccccaagaacagctacgccaccaccgagaacaagaccctgcccagaagcagcagcatggccgccggcctggagagaaacggcagaatgagagtgaaggccatcttcagccacgccgccggcgacaacagcaccctgctgagcttcaaggagggcgacctgatcaccctgctggtgcccgaggccagagacggctggcactacggcgagagcgagaagaccaagatgagaggctggttccccttcagctacaccagagtgctggacagcgacggcagcgacagactgcacatgagcctgcagcagggcaagagcagcagcaccggcaacctgctggacaaggacgacctggccatccccccccccgactacggcgccgccagcagagccttccccgcccagaccgccagcggcttcaagcagagaccctacagcgtggccgtgcccgccttcagccagggcctggacgactacggcgccagaagcatgagcagatag

SEQ ID NO: 9495 - DNA, 1605 bp, Artificial Sequence
  Description of Artificial Sequence: Synthetic coding sequence
atgagcctgagcagaagcgaggagatgcacagactgaccgagaacgtgtacaagaccatcatggagcagttcaaccccagcctgagaaacttcatcgccatgggcaagaactacgagaaggccctggccggcgtgacctacgccgccaagggctacttcgacgccctggtgaagatgggcgagctggccagcgagagccagggcagcaaggagctgggcgacgtgctgttccagatggccgaggtgcacagacagatccagaaccagctggaggagatgctgaagagcttccacaacgagctgctgacccagctggagcagaaggtggagctggacagcagatacctgagcgccgccctgaagaagtaccagaccgagcagagaagcaagggcgacgccctggacaagtgccaggccgagctgaagaagctgagaaagaagagccagggcagcaagaacccccagaagtacagcgacaaggagctgcagtacatcgacgccatcagcaacaagcagggcgagctggagaactacgtgagcgacggctacaagaccgccctgaccgaggagagaagaagattctgcttcctggtggagaagcagtgcgccgtggccaagaacagcgccgcctaccacagcaagggcaaggagctgctggcccagaagctgcccctgtggcagcaggcctgcgccgaccccagcaagatccccgagagagccgtgcagctgatgcagcaggtggccagcaacggcgccaccctgcccagcgccctgagcgccagcaagagcaacctggtgatcagcgaccccatccccggcgccaagcccctgcccgtgccccccgagctggcccccttcgtgggcagaatgagcgcccaggagagcacccccatcatgaacggcgtgaccggccccgacggcgaggactacagcccctgggccgacagaaaggccgcccagcccaagagcctgagccccccccagagccagagcaagctgagcgacagctacagcaacaccctgcccgtgagaaagagcgtgacccccaagaacagctacgccaccaccgagaacaagaccctgcccagaagcagcagcatggccgccggcctggagagaaacggcagaatgagagtgaaggccatcttcagccacgccgccggcgacaacagcaccctgctgagcttcaaggagggcgacctgatcaccctgctggtgcccgaggccagagacggctggcactacggcgagagcgagaagaccaagatgagaggctggttccccttcagctacaccagagtgctggacagcgacggcagcgacagactgcacatgagcctgcagcagggcaagagcagcagcaccggcaacctgctggacaaggacgacctggccatccccccccccgactacggcgccgccagcagagccttccccgcccagaccgccagcggcttcaagcagagaccctacagcgtggccgtgcccgccttcagccagggcctggacgactacggcgccagaagcatgagcagaaaccccttcgcccacgtgcagctgaagcccaccgtgaccaacgacagaagcgcccccctgctgagctag

SEQ ID NO: 9496 - DNA, 1563 bp, Artificial Sequence
  Description of Artificial Sequence: Synthetic coding sequence
atgagcctgagcagaagcgaggagatgcacagactgaccgagaacgtgtacaagaccatcatggagcagttcaaccccagcctgagaaacttcatcgccatgggcaagaactacgagaaggccctggccggcgtgacctacgccgccaagggctacttcgacgccctggtgaagatgggcgagctggccagcgagagccagggcagcaaggagctgggcgacgtgctgttccagatggccgaggtgcacagacagatccagaaccagctggaggagatgctgaagagcttccacaacgagctgctgacccagctggagcagaaggtggagctggacagcagatacctgagcgccgccctgaagaagtaccagaccgagcagagaagcaagggcgacgccctggacaagtgccaggccgagctgaagaagctgagaaagaagagccagggcagcaagaacccccagaagtacagcgacaaggagctgcagtacatcgacgccatcagcaacaagcagggcgagctggagaactacgtgagcgacggctacaagaccgccctgaccgaggagagaagaagattctgcttcctggtggagaagcagtgcgccgtggccaagaacagcgccgcctaccacagcaagggcaaggagctgctggcccagaagctgcccctgtggcagcaggcctgcgccgaccccagcaagatccccgagagagccgtgcagctgatgcagcaggtggccagcaacggcgccaccctgcccagcgccctgagcgccagcaagagcaacctggtgatcagcgaccccatccccggcgccaagcccctgcccgtgccccccgagctggcccccttcgtgggcagaatgagcgcccaggagagcacccccatcatgaacggcgtgaccggccccgacggcgaggactacagcccctgggccgacagaaaggccgcccagcccaagagcctgagccccccccagagccagagcaagctgagcgacagctacagcaacaccctgcccgtgagaaagagcgtgacccccaagaacagctacgccaccaccgagaacaagaccctgcccagaagcagcagcatggccgccggcctggagagaaacggcagaatgagagtgaaggccatcttcagccacgccgccggcgacaacagcaccctgctgagcttcaaggagggcgacctgatcaccctgctggtgcccgaggccagagacggctggcactacggcgagagcgagaagaccaagatgagaggctggttccccttcagctacaccagagtgctggacagcgacggcagcgacagactgcacatgagcctgcagcagggcaagagcagcagcaccggcaacctgctggacaaggacgacctggccatccccccccccgactacggcgccgccagcagagccttccccgcccagaccgccagcggcttcaagcagagaccctacagcgtggccgtgcccgccttcagccagggcctggacgactacggcgccagaagcatgagcagcgccgacgtggaggtggccagattctag

SEQ ID NO: 9497 - DNA, 720 bp, Artificial Sequence
  Description of Artificial Sequence: Synthetic coding sequence
atggcccacgccggcagaaccggctacgacaacagagagatcgtgatgaagtacatccactacaagctgagccagagaggctacgagtgggacgccggcgacgtgggcgccgccccccccggcgccgcccccgcccccggcatcttcagcagccagcccggccacaccccccaccccgccgccagcagagaccccgtggccagaaccagccccctgcagacccccgccgcccccggcgccgccgccggccccgccctgagccccgtgccccccgtggtgcacctgaccctgagacaggccggcgacgacttcagcagaagatacagaagagacttcgccgagatgagcagccagctgcacctgacccccttcaccgccagaggcagattcgccaccgtggtggaggagctgttcagagacggcgtgaactggggcagaatcgtggccttcttcgagttcggcggcgtgatgtgcgtggagagcgtgaacagagagatgagccccctggtggacaacatcgccctgtggatgaccgagtacctgaacagacacctgcacacctggatccaggacaacggcggctgggacgccttcgtggagctgtacggccccagcatgagacccctgttcgacttcagctggctgagcctgaagaccctgctgagcctggccctggtgggcgcctgcatcaccctgggcgcctacctgggccacaagtag

SEQ ID NO: 9498 - DNA, 720 bp, Artificial Sequence; identical to SEQ ID NO: 9497
  Description of Artificial Sequence: Synthetic coding sequence

SEQ ID NO: 9499 - DNA, 618 bp, Artificial Sequence
  Description of Artificial Sequence: Synthetic coding sequence
atggcccacgccggcagaaccggctacgacaacagagagatcgtgatgaagtacatccactacaagctgagccagagaggctacgagtgggacgccggcgacgtgggcgccgccccccccggcgccgcccccgcccccggcatcttcagcagccagcccggccacaccccccaccccgccgccagcagagaccccgtggccagaaccagccccctgcagacccccgccgcccccggcgccgccgccggccccgccctgagccccgtgccccccgtggtgcacctgaccctgagacaggccggcgacgacttcagcagaagatacagaagagacttcgccgagatgagcagccagctgcacctgacccccttcaccgccagaggcagattcgccaccgtggtggaggagctgttcagagacggcgtgaactggggcagaatcgtggccttcttcgagttcggcggcgtgatgtgcgtggagagcgtgaacagagagatgagccccctggtggacaacatcgccctgtggatgaccgagtacctgaacagacacctgcacacctggatccaggacaacggcggctgggtgggcgccctgggcgacgtgagcctgggctag

SEQ ID NO: 9500 - DNA, 1578 bp, Artificial Sequence
  Description of Artificial Sequence: Synthetic coding sequence
atgaaggccctgatcgccgccctgctgctgatcaccctgcagtacagctgcgccgtgagccccaccgactgcagcgccgtggagcccgaggccgagaaggccctggacctgatcaacaagagaagaagagacggctacctgttccagctgctgagaatcgccgacgcccacctggacagagtggagaacaccaccgtgtactacctggtgctggacgtgcaggagagcgactgcagcgtgctgagcagaaagtactggaacgactgcgagccccccgacagcagaagacccagcgagatcgtgatcggccagtgcaaggtgatcgccaccagacacagccacgagagccaggacctgagagtgatcgacttcaactgcaccaccagcagcgtgagcagcgccctggccaacaccaaggacagccccgtgctgatcgacttcttcgaggacaccgagagatacagaaagcaggccaacaaggccctggagaagtacaaggaggagaacgacgacttcgccagcttcagagtggacagaatcgagagagtggccagagtgagaggcggcgagggcaccggctacttcgtggacttcagcgtgagaaactgccccagacaccacttccccagacaccccaacgtgttcggcttctgcagagccgacctgttctacgacgtggaggccctggacctggagagccccaagaacctggtgatcaactgcgaggtgttcgacccccaggagcacgagaacatcaacggcgtgcccccccacctgggccaccccttccactggggcggccacgagagaagcagcaccaccaagccccccttcaagccccacggcagcagagaccaccaccacccccacaagccccacgagcacggccccccccccccccccgacgagagagaccacagccacggcccccccctgccccagggccccccccccctgctgcccatgagctgcagcagctgccagcacgccaccttcggcaccaacggcgcccagagacacagccacaacaacaacagcagcgacctgcacccccacaagcaccacagccacgagcagcacccccacggccaccacccccacgcccaccacccccacgagcacgacacccacagacagcacccccacggccaccacccccacggccaccacccccacggccaccacccccacggccaccacccccacggccaccacccccactgccacgacttccaggactacggcccctgcgacccccccccccacaaccagggccactgctgccacggccacggccccccccccggccacctgagaagaagaggccccggcaagggccccagacccttccactgcagacagatcggcagcgtgtacagactgccccccctgagaaagggcgaggtgctgcccctgcccgaggccaacttccccagcttccccctgccccaccacaagcaccccctgaagcccgacaaccagcccttcccccagagcgtgagcgagagctgccccggcaagttcaagagcggcttcccccaggtgagcatgttcttcacccacaccttccccaagtag

SEQ ID NO: 9501 - DNA, 2121 bp, Artificial Sequence
  Description of Artificial Sequence: Synthetic coding sequence
atggccagccccgccgacagctgcatccagttcaccagacacgccagcgacgtgctgctgaacctgaacagactgagaagcagagacatcctgaccgacgtggtgatcgtggtgagcagagagcagttcagagcccacaagaccgtgctgatggcctgcagcggcctgttctacagcatcttcaccgaccagctgaagtgcaacctgagcgtgatcaacctggaccccgagatcaaccccgagggcttctgcatcctgctggacttcatgtacaccagcagactgaacctgagagagggcaacatcatggccgtgatggccaccgccatgtacctgcagatggagcacgtggtggacacctgcagaaagttcatcaaggccagcgaggccgagatggtgagcgccatcaagccccccagagaggagttcctgaacagcagaatgctgatgccccaggacatcatggcctacagaggcagagaggtggtggagaacaacctgcccctgagaagcgcccccggctgcgagagcagagccttcgcccccagcctgtacagcggcctgagcaccccccccgccagctacagcatgtacagccacctgcccgtgagcagcctgctgttcagcgacgaggagttcagagacgtgagaatgcccgtggccaaccccttccccaaggagagagccctgccctgcgacagcgccagacccgtgcccggcgagtacagcagacccaccctggaggtgagccccaacgtgtgccacagcaacatctacagccccaaggagaccatccccgaggaggccagaagcgacatgcactacagcgtggccgagggcctgaagcccgccgcccccagcgccagaaacgccccctacttcccctgcgacaaggccagcaaggaggaggagagacccagcagcgaggacgagatcgccctgcacttcgagccccccaacgcccccctgaacagaaagggcctggtgagcccccagagcccccagaagagcgactgccagcccaacagccccaccgagagctgcagcagcaagaacgcctgcatcctgcaggccagcggcagcccccccgccaagagccccaccgaccccaaggcctgcaactggaagaagtacaagttcatcgtgctgaacagcctgaaccagaacgccaagcccgagggccccgagcaggccgagctgggcagactgagccccagagcctacaccgccccccccgcctgccagccccccatggagcccgagaacctggacctgcagagccccaccaagctgagcgccagcggcgaggacagcaccatcccccaggccagcagactgaacaacatcgtgaacagaagcatgaccggcagccccagaagcagcagcgagagccacagccccctgtacatgcacccccccaagtgcaccagctgcggcagccagagcccccagcacgccgagatgtgcctgcacaccgccggccccaccttccccgaggagatgggcgagacccagagcgagtacagcgacagcagctgcgagaacggcgccttcttctgcaacgagtgcgactgcagattcagcgaggaggccagcctgaagagacacaccctgcagacccacagcgacaagccctacaagtgcgacagatgccaggccagcttcagatacaagggcaacctggccagccacaagaccgtgcacaccggcgagaagccctacagatgcaacatctgcggcgcccagttcaacagacccgccaacctgaagacccacaccagaatccacagcggcgagaagccctacaagtgcgagacctgcggcgccagattcgtgcaggtggcccacctgagagcccacgtgctgatccacaccggcgagaagccctacccctgcgagatctgcggcaccagattcagacacctgcagaccctgaagagccacctgagaatccacaccggcgagaagccctaccactgcgagaagtgcaacctgcacttcagacacaagagccagctgagactgcacctgagacagaagcacggcgccatcaccaacaccaaggtgcagtacagagtgagcgccaccgacctgccccccgagctgcccaaggcctgctag

SEQ ID NO: 9502 - DNA, 369 bp, Artificial Sequence
  Description of Artificial Sequence: Synthetic coding sequence
atggccagccccgccgacagctgcatccagttcaccagacacgccagcgacgtgctgctgaacctgaacagactgagaagcagagacatcctgaccgacgtggtgatcgtggtgagcagagagcagttcagagcccacaagaccgtgctgatggcctgcagcggcctgttctacagcatcttcaccgaccagctgaagtgcaacctgagcgtgatcaacctggaccccgagatcaaccccgagggcttctgcatcctgctggacttcatgtacaccagcagactgaacctgagagagggcaacatcatggccgtgatggccaccgccatgtacctgcagatggagcacgtggtggacacctgcagatag

SEQ ID NO: 9503 - DNA, 315 bp, Artificial Sequence
  Description of Artificial Sequence: Synthetic coding sequence
atggccagccccgccgacagctgcatccagttcaccagacacgccagcgacgtgctgctgaacctgaacagactgagaagcagagacatcctgaccgacgtggtgatcgtggtgagcagagagcagttcagagcccacaagaccgtgctgatggcctgcagcggcctgttctacagcatcttcaccgaccagctgaagtgcaacctgagcgtgatcaacctggaccccgagatcaaccccgagggcttctgcatcctgctggacttcatgtacaccagcagactgaacctgagagagggcaacatcatggcctag

SEQ ID NO: 9504 - DNA, 1953 bp, Artificial Sequence
  Description of Artificial Sequence: Synthetic coding sequence
atggccagccccgccgacagctgcatccagttcaccagacacgccagcgacgtgctgctgaacctgaacagactgagaagcagagacatcctgaccgacgtggtgatcgtggtgagcagagagcagttcagagcccacaagaccgtgctgatggcctgcagcggcctgttctacagcatcttcaccgaccagctgaagtgcaacctgagcgtgatcaacctggaccccgagatcaaccccgagggcttctgcatcctgctggacttcatgtacaccagcagactgaacctgagagagggcaacatcatggccgtgatggccaccgccatgtacctgcagatggagcacgtggtggacacctgcagaaagttcatcaaggccagcgaggccgagatggtgagcgccatcaagccccccagagaggagttcctgaacagcagaatgctgatgccccaggacatcatggcctacagaggcagagaggtggtggagaacaacctgcccctgagaagcgcccccggctgcgagagcagagccttcgcccccagcctgtacagcggcctgagcaccccccccgccagctacagcatgtacagccacctgcccgtgagcagcctgctgttcagcgacgaggagttcagagacgtgagaatgcccgtggccaaccccttccccaaggagagagccctgccctgcgacagcgccagacccgtgcccggcgagtacagcagacccaccctggaggtgagccccaacgtgtgccacagcaacatctacagccccaaggagaccatccccgaggaggccagaagcgacatgcactacagcgtggccgagggcctgaagcccgccgcccccagcgccagaaacgccccctacttcccctgcgacaaggccagcaaggaggaggagagacccagcagcgaggacgagatcgccctgcacttcgagccccccaacgcccccctgaacagaaagggcctggtgagcccccagagcccccagaagagcgactgccagcccaacagccccaccgagagctgcagcagcaagaacgcctgcatcctgcaggccagcggcagcccccccgccaagagccccaccgaccccaaggcctgcaactggaagaagtacaagttcatcgtgctgaacagcctgaaccagaacgccaagcccgagggccccgagcaggccgagctgggcagactgagccccagagcctacaccgccccccccgcctgccagccccccatggagcccgagaacctggacctgcagagccccaccaagctgagcgccagcggcgaggacagcaccatcccccaggccagcagactgaacaacatcgtgaacagaagcatgaccggcagccccagaagcagcagcgagagccacagccccctgtacatgcacccccccaagtgcaccagctgcggcagccagagcccccagcacgccgagatgtgcctgcacaccgccggccccaccttccccgaggagatgggcgagacccagagcgagtacagcgacagcagctgcggcgagaagccctacagatgcaacatctgcggcgcccagttcaacagacccgccaacctgaagacccacaccagaatccacagcggcgagaagccctacaagtgcgagacctgcggcgccagattcgtgcaggtggcccacctgagagcccacgtgctgatccacaccggcgagaagccctacccctgcgagatctgcggcaccagattcagacacctgcagaccctgaagagccacctgagaatccacaccggcgagaagccctaccactgcgagaagtgcaacctgcacttcagacacaagagccagctgagactgcacctgagacagaagcacggcgccatcaccaacaccaaggtgcagtacagagtgagcgccaccgacctgccccccgagctgcccaaggcctgctag

SEQ ID NO: 9505 - DNA, 306 bp, Artificial Sequence
  Description of Artificial Sequence: Synthetic coding sequence
atgaagttcggcatgggcagcgcccaggcctgcccctgccaggtgcccagagccgccagcaccacctgggtgccctgccagatctgcgagaccagaggcgccgccgccgccccccccctgaccctggagggccccgtgcagagccaccacggcacccccgccctgacccagggcccccagagccccagagacggcgcccagctgggcgcctgcaccagacccgtggacgtgagagacagcggcggcagacccctgcccccccccgacaccctggccagcgccggcgacttcctgtgcaccatgtag

SEQ ID NO: 9506 - DNA, 396 bp, Artificial Sequence
  Description of Artificial Sequence: Synthetic coding sequence
atgaagttcggcatgggcagcgcccaggcctgcccctgccaggtgcccagagccgccagcaccacctgggtgccctgccagatctgcggcccccagcccagcctgagcctggccgagcagcacctggagagccccgtgcccagcgcccccggcgccctggccggcggccccacccaggccgcccccggcgtgagaggcgaggaggagcagtgggccagagagatcggcgcccagctgagaagaatggccgacgacctgaacgcccagtacgagagaagaagacaggaggagcagcagagacacagacccagcccctggagagtgctgtacaacctgatcatgggcctgctgcccctgcccagaggccacagagcccccgagatggagcccaactag

SEQ ID NO: 9507 - DNA, 582 bp, Artificial Sequence
  Description of Artificial Sequence: Synthetic coding sequence
atggccagagccagacaggagggcagcagccccgagcccgtggagggcctggccagagacggccccagacccttccccctgggcagactggtgcccagcgccgtgagctgcggcctgtgcgagcccggcctggccgccgcccccgccgcccccaccctgctgcccgccgcctacctgtgcgcccccaccgccccccccgccgtgaccgccgccctgggcggcagcagatggcccggcggccccagaagcagacccagaggccccagacccgacggcccccagcccagcctgagcctggccgagcagcacctggagagccccgtgcccagcgcccccggcgccctggccggcggccccacccaggccgcccccggcgtgagaggcgaggaggagcagtgggccagagagatcggcgcccagctgagaagaatggccgacgacctgaacgcccagtacgagagaagaagacaggaggagcagcagagacacagacccagcccctggagagtgctgtacaacctgatcatgggcctgctgcccctgcccagaggccacagagcccccgagatggagcccaactag

SEQ ID NO: 9508 - DNA, 786 bp, Artificial Sequence
  Description of Artificial Sequence: Synthetic coding sequence
atgaagttcggcatgggcagcgcccaggcctgcccctgccaggtgcccagagccgccagcaccacctgggtgccctgccagatctgcggccccagagagagacacggccccagaacccccggcggccagctgcccggcgccagaagaggccccggccccagaagacccgcccccctgcccgccagaccccccggcgccctgggcagcgtgctgagacccctgagagccagacccggctgcagacccagaagaccccaccccgccgccagatgcctgcccctgagaccccacagacccaccagaagacacagaagacccggcggcttccccctggcctggggcagcccccagcccgcccccagacccgcccccggcagaagcagcgccctggccctggccggcggcgccgcccccggcgtggccagagcccagagacccggcggcagcggcggcagaagccaccccggcggccccggcagccccagaggcggcggcaccgtgggccccggcgacagaggccccgccgccgccgacggcggcagaccccagagaaccgtgagagccgccgagaccagaggcgccgccgccgccccccccctgaccctggagggccccgtgcagagccaccacggcacccccgccctgacccagggcccccagagccccagagacggcgcccagctgggcgcctgcaccagacccgtggacgtgagagacagcggcggcagacccctgcccccccccgacaccctggccagcgccggcgacttcctgtgcaccatgtag

SEQ ID NO: 9509 - DNA, 1308 bp, Artificial Sequence
  Description of Artificial Sequence: Synthetic coding sequence
atgctgtgcggcttccaggaggacgccacccccccccccccccccagacccagaagactgcacagaagactgcccagacccgaggaggtgggcatgctgagcctgccccccggcctgctgaccgtgagcggcagcgccgccgccgccgacgccgtgcccctgagacccggcgactgggccggcgtgagcaccgccgacagaggcgagagagcccccctgggccccgccttctgcgacctggccgtgagccccaccagccccgcctggagaggcgaggaggacgagggcgccaaggccagcagcggcgacatcggcagcctggactaccaggagttcgtggtggacatcgagagcagactgagaatggagggcgtggagctgaaggaggagtggcaggacgaggacttccccatccccctgcccgaggacgacagcatcgaggccgacatcctggccatcaccggccccgaggaccagcccggcagcctggaggtgaacggcaacaaggtgagaaagaagctgatggcccccgacatcagcctgaccctggaccccagcgacggcagcgtgctgagcgacgacctggacgagagcggcgagatcgacctggacggcctggacacccccagcgagaacagcaacgagttcgagtgggaggacgacctgcccaagcccaagaccaccgaggtgatcagaaagggcagcatcaccgagtacaccgccgccgaggagaaggaggacggcagaagatggagaatgttcagaatcggcgagcaggaccacagagtggacatgaaggccatcgagccctacaagaaggtgatcagccacggcggctactacggcgacggcctgaacgccatcgtggtgttcgccgtgtgcttcatgcccgagagcagccagcccaactacagatacctgatggacaacctgttcaagtacgtgatcggcaccctggagctgctggtggccgagaactacatgatcgtgtacctgaacggcgccaccaccagaagaaagatgcccagcctgggctggctgagaaagtgctaccagcagatcgacagaagactgagaaagaacctgaagagcctgatcatcgtgcaccccagctggttcatcagaaccctgctggccgtgaccagacccttcatcagcagcaagttcagccagaagatcagatacgtgttcaacctggccgagctggccgagctggtgcccatggagtacgtgggcatccccgagtgcatcaagcaggtggaccaggagctgaacggcaagcaggacgagcccaagaacgagcagtag

SEQ ID NO: 9510 - DNA, 1131 bp, Artificial Sequence
  Description of Artificial Sequence: Synthetic coding sequence
atggagccctgccccagcagcgcccccccccccttctaccccggcgtgggcgaggtggccggcctgagatggttcagcatctacgaccagagacccagctggtacagaaccaagaagctgggcctgctggacatcggcagcctggactaccaggagttcgtggtggacatcgagagcagactgagaatggagggcgtggagctgaaggaggagtggcaggacgaggacttccccatccccctgcccgaggacgacagcatcgaggccgacatcctggccatcaccggccccgaggaccagcccggcagcctggaggtgaacggcaacaaggtgagaaagaagctgatggcccccgacatcagcctgaccctggaccccagcgacggcagcgtgctgagcgacgacctggacgagagcggcgagatcgacctggacggcctggacacccccagcgagaacagcaacgagttcgagtgggaggacgacctgcccaagcccaagaccaccgaggtgatcagaaagggcagcatcaccgagtacaccgccgccgaggagaaggaggacggcagaagatggagaatgttcagaatcggcgagcaggaccacagagtggacatgaaggccatcgagccctacaagaaggtgatcagccacggcggctactacggcgacggcctgaacgccatcgtggtgttcgccgtgtgcttcatgcccgagagcagccagcccaactacagatacctgatggacaacctgttcaagtacgtgatcggcaccctggagctgctggtggccgagaactacatgatcgtgtacctgaacggcgccaccaccagaagaaagatgcccagcctgggctggctgagaaagtgctaccagcagatcgacagaagactgagaaagaacctgaagagcctgatcatcgtgcaccccagctggttcatcagaaccctgctggccgtgaccagacccttcatcagcagcaagttcagccagaagatcagatacgtgttcaacctggccgagctggccgagctggtgcccatggagtacgtgggcatccccgagtgcatcaagcaggtggaccaggagctgaacggcaagcaggacgagcccaagaacgagcagtag

SEQ ID NO: 9511 - DNA, 939 bp, Artificial Sequence
  Description of Artificial Sequence: Synthetic coding sequence
atggccaaggtgttcagcttcatcctggtgaccaccgccctgaccatgggcagagagatcagcgccctggaggactgcgcccaggagcagatgagactgagagcccaggtgagactgctggagaccagagtgaagcagcagcaggtgaagatcaagcagctgctgcaggagaacgaggtgcagttcctggacaagggcgacgagaacaccgtgatcgacctgggcagcaagagacagtacgccgactgcagcgagatcttcaacgacggctacaagctgagcggcttctacaagatcaagcccctgcagagccccgccgagttcagcgtgtactgcgacatgagcgacggcggcggctggaccgtgatccagagaagaagcgacggcagcgagaacttcaacagaggctggaaggactacgagaacggcttcggcaacttcgtgcagaagcacggcgagtactggctgggcaacaagaacctgcacttcctgaccacccaggaggactacaccctgaagatcgacctggccgacttcgagaagaacagcagatacgcccagtacaagaacttcaaggtgggcgacgagaagaacttctacgagctgaacatcggcgagtacagcggcaccgccggcgacagcctggccggcaacttccaccccgaggtgcagtggtgggccagccaccagagaatgaagttcagcacctgggacagagaccacgacaactacgagggcaactgcgccgaggaggaccagagcggctggtggttcaacagatgccacagcgccaacctgaacggcgtgtactacagcggcccctacaccgccaagaccgacaacggcatcgtgtggtacacctggcacggctggtggtacagcctgaagagcgtggtgatgaagatcagacccaacgacttcatccccaacgtgatctag

SEQ ID NO: 9512 - DNA, 660 bp, Artificial Sequence
  Description of Artificial Sequence: Synthetic coding sequence
atgagcagccacctggtggagccccccccccccctgcacaacaacaacaacaactgcgaggagaacgagcagagcctgcccccccccgccggcctgaacagcagctgggtggagctgcccatgaacagcagcaacggcaacgacaacggcaacggcaagaacggcggcctggagcacgtgcccagcagcagcagcatccacaacggcgacatggagaagatcctgctggacgcccagcacgagagcggccagagcagcagcagaggcagcagccactgcgacagccccagcccccaggaggacggccagatcatgttcgacgtggagatgcacaccagcagagaccacagcagccagagcgaggaggaggtggtggagggcgagaaggaggtggaggccctgaagaagagcgccgactgggtgagcgactggagcagcagacccgagaacatcccccccaaggagttccacttcagacaccccaagagaagcgtgagcctgagcatgagaaagagcggcgccatgaagaagggcggcatcttcagcgccgagttcctgaaggtgttcatccccagcctgttcctgagccacgtgctggccctgggcctgggcatctacatcggcaagagactgagcacccccagcgccagcacctactag

SEQ ID NO: 9513 - DNA, 540 bp, Artificial Sequence
  Description of Artificial Sequence: Synthetic coding sequence
atgaacagcagcaacggcaacgacaacggcaacggcaagaacggcggcctggagcacgtgcccagcagcagcagcatccacaacggcgacatggagaagatcctgctggacgcccagcacgagagcggccagagcagcagcagaggcagcagccactgcgacagccccagcccccaggaggacggccagatcatgttcgacgtggagatgcacaccagcagagaccacagcagccagagcgaggaggaggtggtggagggcgagaaggaggtggaggccctgaagaagagcgccgactgggtgagcgactggagcagcagacccgagaacatcccccccaaggagttccacttcagacaccccaagagaagcgtgagcctgagcatgagaaagagcggcgccatgaagaagggcggcatcttcagcgccgagttcctgaaggtgttcatccccagcctgttcctgagccacgtgctggccctgggcctgggcatctacatcggcaagagactgagcacccccagcgccagcacctactag

SEQ ID NO: 9514 - DNA, 540 bp, Artificial Sequence; identical to SEQ ID NO: 9513
  Description of Artificial Sequence: Synthetic coding sequence

SEQ ID NO: 9515 - DNA, 540 bp, Artificial Sequence; identical to SEQ ID NO: 9513
  Description of Artificial Sequence: Synthetic coding sequence

SEQ ID NO: 9516 - DNA, 636 bp, Artificial Sequence
  Description of Artificial Sequence: Synthetic coding sequence
atggccagcggccagggccccggcccccccagacaggagtgcggcgagcccgccctgcccagcgccagcgaggagcaggtggcccaggacaccgaggaggtgttcagaagctacgtgttctacagacaccagcaggagcaggaggccgagggcgtggccgcccccgccgaccccgagatggtgaccctgcccctgcagcccagcagcaccatgggccaggtgggcagacagctggccatcatcggcgacgacatcaacagaagatacgacagcgagttccagaccatgctgcagcacctgcagcccaccgccgagaacgcctacgagtacttcaccaagatcgccaccagcctgttcgagagcggcatcaactggggcagagtggtggccctgctgggcttcggctacagactggccctgcacgtgtaccagcacggcctgaccggcttcctgggccaggtgaccagattcgtggtggacttcatgctgcaccactgcatcgccagatggatcgcccagagaggcggctgggtggccgccctgaacctgggcaacggccccatcctgaacgtgctggtggtgctgggcgtggtgctgctgggccagttcgtggtgagaagattcttcaagagctag

SEQ ID NO: 9517 - DNA, 576 bp, Artificial Sequence
  Description of Artificial Sequence: Synthetic coding sequence
atggccagcggccagggccccggcccccccagacaggagtgcggcgagcccgccctgcccagcgccagcgaggagcaggtggcccaggacaccgaggaggtgttcagaagctacgtgttctacagacaccagcagcagcccagcagcaccatgggccaggtgggcagacagctggccatcatcggcgacgacatcaacagaagatacgacagcgagttccagaccatgctgcagcacctgcagcccaccgccgagaacgcctacgagtacttcaccaagatcgccaccagcctgttcgagagcggcatcaactggggcagagtggtggccctgctgggcttcggctacagactggccctgcacgtgtaccagcacggcctgaccggcttcctgggccaggtgaccagattcgtggtggacttcatgctgcaccactgcatcgccagatggatcgcccagagaggcggctgggtggccgccctgaacctgggcaacggccccatcctgaacgtgctggtggtgctgggcgtggtgctgctgggccagttcgtggtgagaagattcttcaagagctag

SEQ ID NO: 9518 - DNA, 636 bp, Artificial Sequence; identical to SEQ ID NO: 9516
  Description of Artificial Sequence: Synthetic coding sequence

SEQ ID NO: 9519 - DNA, 462 bp, Artificial Sequence
  Description of Artificial Sequence: Synthetic coding sequence
atggccagcggccagggccccggcccccccagacaggagtgcggcgagcccgccctgcccagcgccagcgaggagcaggtggcccaggacaccgaggaggtgttcagaagctacgtgttctacagacaccagcaggagcaggaggccgagggcgtggccgcccccgccgaccccgagatggtgaccctgcccctgcagcccagcagcaccatgggccaggtgggcagacagctggccatcatcggcgacgacatcaacagaagatacgacagcgagttccagaccatgctgcagcacctgcagcccaccgccgagaacgcctacgagtacttcaccaagatcgccaccagacccgccgccacccccaccgcctgcctgagagtggccagcatcggcgccgtgtggtggctgttctgggccagcgccaccgtgtggccctacaccagcaccagcatggcctag

SEQ ID NO: 9520 - DNA, 507 bp, Artificial Sequence
  Description of Artificial Sequence: Synthetic coding sequence
atgttccagatccccgagttcgagcccagcgagcaggaggacagcagcagcgccgagagaggcctgggccccagccccgccggcgacggccccagcggcagcggcaagcaccacagacaggcccccggcctgctgtgggacgccagccaccagcaggagcagcccaccagcagcagccaccacggcggcgccggcgccgtggagatcagaagcagacacagcagctaccccgccggcaccgaggacgacgagggcatgggcgaggagcccagccccttcagaggcagaagcagaagcgccccccccaacctgtgggccgcccagagatacggcagagagctgagaagaatgagcgacgagttcgtggacagcttcaagaagggcctgcccagacccaagagcgccggcaccgccacccagatgagacagagcagcagctggaccagagtgttccagagctggtgggacagaaacctgggcagaggcagcagcgcccccagccagtag

SEQ ID NO: 9521 - DNA, 507 bp, Artificial Sequence; identical to SEQ ID NO: 9520
  Description of Artificial Sequence: Synthetic coding sequence

SEQ ID NO: 9522 - DNA, 450 bp, Artificial Sequence
  Description of Artificial Sequence: Synthetic coding sequence
atgttccagatccccgagttcgagcccagcgagcaggaggacagcagcagcgccgagagaggcctgggccccagccccgccggcgacggccccagcggcagcggcaagcaccacagacaggcccccggcctgctgtgggacgccagccaccagcaggagcagcccaccagcagcagccaccacggcggcgccggcgccgtggagatcagaagcagacacagcagctaccccgccggcaccgaggacgacgagggcatgggcgaggagcccagccccttcagaggcagaagcagaagcgccccccccaacctgtgggccgcccagagatacggcagagagctgagaagaatgagcgacgagttcgtggacagcttcaagaagggcctgcccagacccaagagcgccggcaccgccacccagatgagacagagcagcagaagactgagatag

SEQ ID NO: 9523 - DNA, 591 bp, Artificial Sequence
  Description of Artificial Sequence: Synthetic coding sequence
atgaacagaagccaggaggtgaccagagacgaggagagcaccagaagcgaggaggtgaccagagaggagatggccgccgccggcctgaccgtgaccgtgacccacagcaacgagaagcacgacctgcacgtgaccagccagcagggcagcagcgagcccgtggtgcaggacctggcccaggtggtggaggaggtgatcggcgtgccccagagcttccagaagctgatcttcaagggcaagagcctgaaggagatggagacccccctgagcgccctgggcatccaggacggctgcagagtgatgctgatcggcaagaagaacagcccccaggaggaggtggagctgaagaagctgaagcacctggagaagagcgtggagaagatcgccgaccagctggaggagctgaacaaggagctgaccggcatccagcagggcttcctgcccaaggacctgcaggccgaggccctgtgcaagctggacagaagagtgaaggccaccatcgagcagttcatgaagatcctggaggagatcgacaccctgatcctgcccgagaacttccccaccctgaccctggtgctgaacgagaagtag

SEQ ID NO: 9524 - DNA, 693 bp, Artificial Sequence
  Description of Artificial Sequence: Synthetic coding sequence
atgaacagaagccaggaggtgaccagagacgaggagagcaccagaagcgaggaggtgaccagagaggagatggccgccgccggcctgaccgtgaccgtgacccacagcaacgagaagcacgacctgcacgtgaccagccagcagggcagcagcgagcccgtggtgcaggacctggcccaggtggtggaggaggtgatcggcgtgccccagagcttccagaagctgatcttcaagggcaagagcctgaaggagatggagacccccctgagcgccctgggcatccaggacggctgcagagtgatgctgatcggcaagaagaacagcccccaggaggaggtggagctgaagaagctgaagcacctggagaagagcgtggagaagatcgccgaccagctggaggagctgaacaaggagctgaccggcatccagcagggcttcctgcccaaggacctgcaggccgaggccctgtgcaagctggacagaagagtgaaggccaccatcgagcagttcatgaagatcctggaggagatcgacaccctgatcctgcccgagaacttcaaggacagcagactgaagagaaagggcctggtgaagaaggtgcaggccttcctggccgagtgcgacaccgtggagcagaacatctgccaggagaccgagagactgcagagcaccaacttcgccctggccgagtag

SEQ ID NO: 9525 - DNA, 1038 bp, Artificial Sequence
  Description of Artificial Sequence: Synthetic coding sequence
ctggcccagagaggcggcgccagaagacccagaggcgacagagagagactgggcagcagactgagagccctgagacccggcagagagcccagacagagcgagccccccgcccagagaggccccccccccagcggcagaccccccgccagaagcaccgccagcggccacgacagacccaccagaggcgccgccgccggcgccagaagacccagaatgaagaagaagaccagaagaagaagcaccagaagcgaggagctgaccagaagcgaggagctgaccctgagcgaggaggccacctggagcgaggaggccacccagagcgaggaggccacccagggcgaggagatgaacagaagccaggaggtgaccagagacgaggagagcaccagaagcgaggaggtgaccagagaggagatggccgccgccggcctgaccgtgaccgtgacccacagcaacgagaagcacgacctgcacgtgaccagccagcagggcagcagcgagcccgtggtgcaggacctggcccaggtggtggaggaggtgatcggcgtgccccagagcttccagaagctgatcttcaagggcaagagcctgaaggagatggagacccccctgagcgccctgggcatccaggacggctgcagagtgatgctgatcggcaagaagaacagcccccaggaggaggtggagctgaagaagctgaagcacctggagaagagcgtggagaagatcgccgaccagctggaggagctgaacaaggagctgaccggcatccagcagggcttcctgcccaaggacctgcaggccgaggccctgtgcaagctggacagaagagtgaaggccaccatcgagcagttcatgaagatcctggaggagatcgacaccctgatcctgcccgagaacttcaaggacagcagactgaagagaaagggcctggtgaagaaggtgcaggccttcctggccgagtgcgacaccgtggagcagaacatctgccaggagaccgagagactgcagagcaccaacttcgccctggccgagtag

SEQ ID NO: 9526 - DNA, 1728 bp, Artificial Sequence
  Description of Artificial Sequence: Synthetic coding sequence
atgagcgccgccacccacagccccatgatgcaggtggccagcggcaacggcgacagagaccccctgccccccggctgggagatcaagatcgacccccagaccggctggcccttcttcgtggaccacaacagcagaaccaccacctggaacgaccccagagtgcccagcgagggccccaaggagacccccagcagcgccaacggccccagcagagagggcagcagactgccccccgccagagagggccaccccgtgtacccccagctgagacccggctacatccccatccccgtgctgcacgagggcgccgagaacagacaggtgcaccccttccacgtgtacccccagcccggcatgcagagattcagaaccgaggccgccgccgccgccccccagagaagccagagccccctgagaggcatgcccgagaccacccagcccgacaagcagtgcggccaggtggccgccgccgccgccgcccagccccccgccagccacggccccgagagaagccagagccccgccgccagcgactgcagcagcagcagcagcagcgccagcctgcccagcagcggcagaagcagcctgggcagccaccagctgcccagaggctacatcagcatccccgtgatccacgagcagaacgtgaccagacccgccgcccagcccagcttccaccaggcccagaagacccactaccccgcccagcagggcgagtaccagacccaccagcccgtgtaccacaagatccagggcgacgactgggagcccagacccctgagagccgccagccccttcagaagcagcgtgcagggcgccagcagcagagagggcagccccgccagaagcagcacccccctgcacagccccagccccatcagagtgcacaccgtggtggacagaccccagcagcccatgacccacagagagaccgcccccgtgagccagcccgagaacaagcccgagagcaagcccggccccgtgggccccgagctgccccccggccacatccccatccaggtgatcagaaaggaggtggacagcaagcccgtgagccagaagccccccccccccagcgagaaggtggaggtgaaggtgccccccgcccccgtgccctgccccccccccagccccggccccagcgccgtgcccagcagccccaagagcgtggccaccgaggagagagccgcccccagcaccgcccccgccgaggccaccccccccaagcccggcgaggccgaggccccccccaagcaccccggcgtgctgaaggtggaggccatcctggagaaggtgcagggcctggagcaggccgtggacaacttcgagggcaagaagaccgacaagaagtacctgatgatcgaggagtacctgaccaaggagctgctggccctggacagcgtggaccccgagggcagagccgacgtgagacaggccagaagagacggcgtgagaaaggtgcagaccatcctggagaagctggagcagaaggccatcgacgtgcccggccaggtgcaggtgtacgagctgcagcccagcaacctggaggccgaccagcccctgcaggccatcatggagatgggcgccgtggccgccgacaagggcaagaagaacgccggcaacgccgaggacccccacaccgagacccagcagcccgaggccaccgccgccgccaccagcaaccccagcagcatgaccgacacccccggcaaccccgccgccccctag

SEQ ID NO: 9527 - DNA, 978 bp, Artificial Sequence
  Description of Artificial Sequence: Synthetic coding sequence
atgcaggagacccccagcagcgccaacggccccagcagagagggcagcagactgccccccgccagagagggccaccccgtgtacccccagctgagacccggctacatccccatccccgtgctgcacgagggcgccgagaacagacaggtgcaccccttccacgtgtacccccagcccggcatgcagagattcagaaccgaggccgccgccgccgccccccagagaagccagagccccctgagaggcatgcccgagaccacccagcccgacaagcagtgcggccaggtggccgccgccgccgccgcccagccccccgccagccacggccccgagagaagccagagccccgccgccagcgactgcagcagcagcagcagcagcgccagcctgcccagcagcggcagaagcagcctgggcagccaccagctgcccagaggctacatcagcatccccgtgatccacgagcagaacgtgaccagacccgccgcccagcccagcttccaccaggcccagaagacccactaccccgcccagcagggcgagtaccagacccaccagcccgtgtaccacaagatccagggcgacgactgggagcccagacccctgagagccgccagccccttcagaagcagcgtgcagggcgccagcagcagagagggcagccccgccagaagcagcacccccctgcacagccccagccccatcagagtgcacaccgtggtggacagaccccagcccatgacccacagagagaccgcccccgtgagccagcccgagaacaagcccgagagcaagcccggccccgtgggccccgagctgccccccggccacatccccatccaggtgatcagaaaggaggtggacagcaagcccgtgagccagaagccccccccccccagcgagaaggtggaggtgaaggtgccccccgcccccgtgccctgccccccccccagccccggccccagcgccgtgccctag

SEQ ID NO: 9528 - DNA, 657 bp, Artificial Sequence
  Description of Artificial Sequence: Synthetic coding sequence
atggacggcagcggcgagcagcccagaggcggcggccccaccagcagcgagcagatcatgaagaccggcgccctgctgctgcagggcttcatccaggacagagccggcagaatgggcggcgaggcccccgagctggccctggaccccgtgccccaggacgccagcaccaagaagctgagcgagtgcctgaagagaatcggcgacgagctggacagcaacatggagctgcagagaatgatcgccgccgtggacaccgacagccccagagaggtgttcttcagagtggccgccgacatgttcagcgacggcaacttcaactggggcagagtggtggccctgttctacttcgccagcaagctggtgctgaaggccctgtgcaccaaggtgcccgagctgatcagaaccatcatgggctggaccctggacttcctgagagagagactgctgggctggatccaggaccagggcggctgggtgagactgctgaagcccccccacccccaccacagagccctgaccaccgcccccgccccccccagcctgccccccgccacccccctgggcccctgggccttctggagcagaagccagtggtgccccctgcccatcttcagaagcagcgacgtggtgtacaacgccttcagcctgagagtgtag

SEQ ID NO: 9529 - DNA, 579 bp, Artificial Sequence
  Description of Artificial Sequence: Synthetic coding sequence
atggacggcagcggcgagcagcccagaggcggcggccccaccagcagcgagcagatcatgaagaccggcgccctgctgctgcagggcttcatccaggacagagccggcagaatgggcggcgaggcccccgagctggccctggaccccgtgccccaggacgccagcaccaagaagctgagcgagtgcctgaagagaatcggcgacgagctggacagcaacatggagctgcagagaatgatcgccgccgtggacaccgacagccccagagaggtgttcttcagagtggccgccgacatgttcagcgacggcaacttcaactggggcagagtggtggccctgttctacttcgccagcaagctggtgctgaaggccctgtgcaccaaggtgcccgagctgatcagaaccatcatgggctggaccctggacttcctgagagagagactgctgggctggatccaggaccagggcggctgggacggcctgctgagctacttcggcacccccacctggcagaccgtgaccatcttcgtggccggcgtgctgaccgccagcctgaccatctggaagaagatgggctag

SEQ ID NO: 9530 - DNA, 432 bp, Artificial Sequence
  Description of Artificial Sequence: Synthetic coding sequence
atggacggcagcggcgagcagcccagaggcggcggccccaccagcagcgagcagatcatgaagaccggcgccctgctgctgcagggcatgatcgccgccgtggacaccgacagccccagagaggtgttcttcagagtggccgccgacatgttcagcgacggcaacttcaactggggcagagtggtggccctgttctacttcgccagcaagctggtgctgaaggccctgtgcaccaaggtgcccgagctgatcagaaccatcatgggctggaccctggacttcctgagagagagactgctgggctggatccaggaccagggcggctgggacggcctgctgagctacttcggcacccccacctggcagaccgtgaccatcttcgtggccggcgtgctgaccgccagcctgaccatctggaagaagatgggctag

SEQ ID NO: 9531 - DNA, 126 bp, Artificial Sequence
  Description of Artificial Sequence: Synthetic coding sequence
atggacggcagcggcgagcagcccagaggcggcgtgagcagcagaatcgagcagggcgagtggggcggcagacaccccagctggccctggaccagatgcctgagaatgagaccccccagaagctag

SEQ ID NO: 9532 - DNA, 540 bp, Artificial Sequence
  Description of Artificial Sequence: Synthetic coding sequence
atggacggcagcggcgagcagcccagaggcggcggccccaccagcagcgagcagatcatgaagaccggcgccctgctgctgcagggcttcatccaggacagagccggcagaatgggcggcgaggcccccgagctggccctggaccccgtgccccaggacgccagcaccaagaagctgagcgagtgcctgaagagaatcggcgacgagctggacagcaacatggagctgcagagaatgatcgccgccgtggacaccgacagccccagagaggtgttcttcagagtggccgccgacatgttcagcgacggcaacttcaactggggcagagtggtggccctgttctacttcgccagcaagctggtgctgaaggccctgtgcaccaaggtgcccgagctgatcagaaccatcatgggctggaccctggacttcctgagagagagactgctgggctggatccaggaccagggcggctggaccgtgaccatcttcgtggccggcgtgctgaccgccagcctgaccatctggaagaagatgggctag

SEQ ID NO: 9533 - DNA, 495 bp, Artificial Sequence
  Description of Artificial Sequence: Synthetic coding sequence
atggacggcagcggcgagcagcccagaggcggcggccccaccagcagcgagcagatcatgaagaccggcgccctgctgctgcagggcttcatccaggacagagccggcagaatgggcggcgaggcccccgagctggccctggaccccgtgccccaggacgccagcaccaagaagctgagcgagtgcctgaagagaatcggcgacgagctggacagcaacatggagctgcagagaatgatcgccgccgtggacaccgacagccccagagaggtgttcttcagagtggccgccgacatgttcagcgacggcaacttcaactggggcagagtggtggccctgttctacttcgccagcaagctggtgctgaaggccggcgtgaagtggagagacctgggcagcctgcagcccctgccccccggcttcaagagattcacctgcctgagcatccccagaagctgggactacagaccctgcgcccccagatgcagaaactag

SEQ ID NO: 9534 - DNA, 1806 bp, Artificial Sequence
  Description of Artificial Sequence: Synthetic coding sequence
atggcctacgacgacagcgtgaagaaggaggactgcttcgacggcgaccacaccttcgaggacatcggcctggccgccggcagaagccagagagagaagaagagaagctacaaggacttcctgagagaggaggaggagatcgccgcccaggtgagaaacagcagcaagaagaagctgaaggacagcgagctgtacttcctgggcaccgacacccacaagaagaagagaaagcacagcagcgacgactactactacggcgacatcagcagcctggagagcagccagaagaagaagaagaagagcagcccccagagcaccgacaccgccatggacctgctgaaggccatcaccagccccctggccgccggcagcaagcccagcaagaagaccggcgagaagagcagcggcagcagcagccacagcgagagcaagaaggagcaccacagaaagaaggtgagcggcagcagcggcgagctgcccctggaggacggcggcagccacaagagcaagaagatgaagcccctgtacgtgaacaccgagaccctgaccctgagagagcccgacggcctgaagatgaagctgatcctgagccccaaggagaagggcagcagcagcgtggacgaggagagcttccagtaccccagccagcaggccaccgtgaagaagagcagcaagaagagcgccagagacgagcagggcgccctgctgctgggccacgagctgcagagcttcctgaagaccgccagaaagaagcacaagagcagcagcgacgcccacagcagccccggccccgagggctgcggcagcgacgccagccagttcgccgagagccacagcgccaacctggacctgagcggcctggagcccatcctggtggagagcgacagcagcagcggcggcgagctggaggccggcgagctggtgatcgacgacagctacagagagatcaagaagaagaagaagagcaagaagagcaagaagaagaaggacaaggagaagcacaaggagaagagacacagcaagagcaagagaagcctgggcctgagcgccgtgcccgtgggcgaggtgaccgtgaccagcggccccccccccagcatcccctacgccggcgccgccgccccccccctgcccctgcccggcctgcacaccgacggccacagcgagaagaagaagaagaaggaggagaaggacaaggagagagagagaggcgagaagcccaagaagaagaacatgagcgcctaccaggtgttctgcaaggagtacagagtgaccatcgtggccgaccaccccggcatcgacttcggcgagctgagcaagaagctggccgaggtgtggaagcagctgcccgagaaggacaagctgatctggaagcagaaggcccagtacctgcagcacaagcagaacaaggccgaggccaccaccgtgaagagaaaggccagcagcagcgagggcagcatgaaggtgaaggccagcagcgtgggcgtgctgagcccccagaagaagagcccccccaccaccatgctgctgcccgccagccccgccaaggcccccgagaccgagcccatcgacgtggccgcccacctgcagctgctgggcgagagcctgagcctgatcggccacagactgcaggagaccgagggcatggtggccgtgagcggcagcctgagcgtgctgctggacagcatcatctgcgccctgggccccctggcctgcctgaccacccagctgcccgagctgaacggctgccccaagcaggtgctgagcaacaccctggacaacatcgcctacatcatgcccggcctgtag

SEQ ID NO: 9535 - DNA, 702 bp, Artificial Sequence
  Description of Artificial Sequence: Synthetic coding sequence
atgagccagagcaacagagagctggtggtggacttcctgagctacaagctgagccagaagggctacagctggagccagttcagcgacgtggaggagaacagaaccgaggcccccgagggcaccgagagcgagatggagacccccagcgccatcaacggcaaccccagctggcacctggccgacagccccgccgtgaacggcgccaccggccacagcagcagcctggacgccagagaggtgatccccatggccgccgtgaagcaggccctgagagaggccggcgacgagttcgagctgagatacagaagagccttcagcgacctgaccagccagctgcacatcacccccggcaccgcctaccagagcttcgagcaggtggtgaacgagctgttcagagacggcgtgaactggggcagaatcgtggccttcttcagcttcggcggcgccctgtgcgtggagagcgtggacaaggagatgcaggtgctggtgagcagaatcgccgcctggatggccacctacctgaacgaccacctggagccctggatccaggagaacggcggctgggacaccttcgtggagctgtacggcaacaacgccgccgccgagagcagaaagggccaggagagattcaacagatggttcctgaccggcatgaccgtggccggcgtggtgctgctgggcagcctgttcagcagaaagtag

SEQ ID NO: 9536 - DNA, 513 bp, Artificial Sequence
  Description of Artificial Sequence: Synthetic coding sequence
atgagccagagcaacagagagctggtggtggacttcctgagctacaagctgagccagaagggctacagctggagccagttcagcgacgtggaggagaacagaaccgaggcccccgagggcaccgagagcgagatggagacccccagcgccatcaacggcaaccccagctggcacctggccgacagccccgccgtgaacggcgccaccggccacagcagcagcctggacgccagagaggtgatccccatggccgccgtgaagcaggccctgagagaggccggcgacgagttcgagctgagatacagaagagccttcagcgacctgaccagccagctgcacatcacccccggcaccgcctaccagagcttcgagcaggacaccttcgtggagctgtacggcaacaacgccgccgccgagagcagaaagggccaggagagattcaacagatggttcctgaccggcatgaccgtggccggcgtggtgctgctgggcagcctgttcagcagaaagtag

SEQ ID NO: 9537 - DNA, 702 bp, Artificial Sequence; identical to SEQ ID NO: 9535
  Description of Artificial Sequence: Synthetic coding sequence

SEQ ID NO: 9538 - DNA, 567 bp, Artificial Sequence
  Description of Artificial Sequence: Synthetic coding sequence
atgagccagagcaacagagagctggtggtggacttcctgagctacaagctgagccagaagggctacagctggagccagttcagcgacgtggaggagaacagaaccgaggcccccgagggcaccgagagcgagatggagacccccagcgccatcaacggcaaccccagctggcacctggccgacagccccgccgtgaacggcgccaccggccacagcagcagcctggacgccagagaggtgatccccatggccgccgtgaagcaggccctgagagaggccggcgacgagttcgagctgagatacagaagagccttcagcgacctgaccagccagctgcacatcacccccggcaccgcctaccagagcttcgagcaggtggtgaacgagctgttcagagacggcgtgaactggggcagaatcgtggccttcttcagcttcggcggcgccctgtgcgtggagagcgtggacaaggagatgcaggtgctggtgagcagaatcgccgcctggatggccacctacctgaacgaccacctggagccctggatccaggagaacggcggctggtag

SEQ ID NO: 9539 - DNA, 702 bp, Artificial Sequence; identical to SEQ ID NO: 9535
  Description of Artificial Sequence: Synthetic coding sequence

SEQ ID NO: 9540 - DNA, 567 bp, Artificial Sequence; identical to SEQ ID NO: 9538
  Description of Artificial Sequence: Synthetic coding sequence

SEQ ID NO: 9541 - DNA, 147 bp, Artificial Sequence
  Description of Artificial Sequence: Synthetic coding sequence
atgagccagagcaacagagagctggtggtggacttcctgagctacaagctgagccagaagggctacagctggagccagttcagcgacgtggaggagaacagaaccgaggcccccgagggcaccgagagcgagatggagaccccctag

SEQ ID NO: 9542 - DNA, 546 bp, Artificial Sequence
  Description of Artificial Sequence: Synthetic coding sequence
atgagccagagcaacagagagctggtggtggacttcctgagctacaagctgagccagaagggctacagctggagccagttcagcgacgtggaggagaacagaaccgaggcccccgagggcaccgagagcgagatggagacccccagcgccatcaacggcaaccccagctggcacctggccgacagccccgccgtgaacggcgccaccggccacagcagcagcctggacgccagagaggtgatccccatggccgccgtgaagcaggccctgagagaggccggcgacgagttcgagctgagatacagaagagccttcagcgacctgaccagccagctgcacatcacccccggcaccgcctaccagagcttcgagcaggtggtgaacgagctgttcagagacggcgtgaactggggcagaatcgtggccttcttcagcttcggcggcgccctgtgcgtggagagcgtggacaaggagatgcaggtgctggtgagcagaatcgccgcctggatggccacctacctgaacgaccacctggagccctggtag

SEQ ID NO: 9543 - DNA, 618 bp, Artificial Sequence
  Description of Artificial Sequence: Synthetic coding sequence
atgagccagagcaacagagagctggtggtggacttcctgagctacaagctgagccagaagggctacagctggagccagttcagcgacgtggaggagaacagaaccgaggcccccgagggcaccgagagcgagatggagacccccagcgccatcaacggcaaccccagctggcacctggccgacagccccgccgtgaacggcgccaccggccacagcagcagcctggacgccagagaggtgatccccatggccgccgtgaagcaggccctgagagaggccggcgacgagttcgagctgagatacagaagagccttcagcgacctgaccagccagctgcacatcacccccggcaccgcctaccagagcttcgagcaggtggtgaacgagctgttcagagacggcgtgaactggggcagaatcgtggccttcttcagcttcggcggcgccctgtgcgtggagagcgtggacaaggagatgcaggtgctggtgagcagaatcgccgcctggatggccacctacctgaacgaccacctggagccctggatccaggagaacggcggctgggacaccttcgtggagctgtacggcaacaacgccgccgccgagagcagaaagtag

SEQ ID NO: 9544 - DNA, 567 bp, Artificial Sequence; identical to SEQ ID NO: 9538
  Description of Artificial Sequence: Synthetic coding sequence

SEQ ID NO: 9545 - DNA, 615 bp, Artificial Sequence
  Description of Artificial Sequence: Synthetic coding sequence
atggtggaccagctgagagagagaaccaccatggccgaccccctgagagagagaaccgagctgctgctggccgactacctgggctactgcgccagagagcccggcacccccgagcccgcccccagcacccccgaggccgccgtgctgagaagcgccgccgccagactgagacagatccacagaagcttcttcagcgcctacctgggctaccccggcaacagattcgagctggtggccctgatggccgacagcgtgctgagcgacagccccggccccacctggggcagagtggtgaccctggtgaccttcgccggcaccctgctggagagaggccccctggtgaccgccagatggaagaagtggggcttccagcccagactgaaggagcaggagggcgacgtggccagagactgccagagactggtggccctgctgagcagcagactgatgggccagcacagagcctggctgcaggcccagggcggctgggacggcttctgccacttcttcagaacccccttccccctggccttctggagaaagcagctggtgcaggccttcctgagctgcctgctgaccaccgccttcatctacctgtggaccagactgctgtag

SEQ ID NO: 9546 - DNA, 417 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccaggacagaagccccgcccccatgagctgcgacaagagcacccagacccccagccccccctgccaggccttcaaccactacctgagcgccatggccagcatgagacaggccgagcccgccgacatgagacccgagatctggatcgcccaggagctgagaagaatcggcgacgagttcaacgcctactacgccagaagagtgttcctgaacaactaccaggccgccgaggaccaccccagaatggtgatcctgagactgctgagatacatcgtgagactggtgtggagaatgcactag

SEQ ID NO: 9547 - DNA, 339 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccaggacagaagccccgcccccatgagctgcgacaagagcacccagacccccagccccccctgccaggccttcaaccactacctgagcgccatggtggtgatcctggaggacatcggcgacctgagcctgtgcttcggcttcatcttcaccggcctggacctgtacggccaccaccacagccaggacaccgagcagctgaaccacaaggacttcagctag

SEQ ID NO: 9548 - DNA, 519 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccagggcaaccccgagggcaaccacggcggcgagggcgacagctgcccccacggcagcccccagggccccctggccccccccgccagccccggccccttcgccaccagaagccccctgttcatcttcatgagaagaagcagcctgctgagcagaagcagcagcggctacttcagcttcgacaccgacagaagccccgcccccatgagctgcgacaagagcacccagacccccagccccccctgccaggccttcaaccactacctgagcgccatggccagcatgagacaggccgagcccgccgacatgagacccgagatctggatcgcccaggagctgagaagaatcggcgacgagttcaacgcctactacgccagaagaatgcccctgccccccgactag

SEQ ID NO: 9549 - DNA, 219 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccagggcaaccccgagggcaaccacggcggcgagggcgacagctgcccccacggcagcccccagggccccctggccccccccgccagccccggcccctag

SEQ ID NO: 9550 - DNA, 258 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccaggccagcatgagacaggccgagcccgccgacatgagacccgagatctggatcgcccaggagctgagaagaatcggcgacgagttcaacgcctactacgccagaagactggccaagctgctggccagcagcacctag

SEQ ID NO: 9551 - DNA, 597 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccagggcaaccccgagggcaaccacggcggcgagggcgacagctgcccccacggcagcccccagggccccctggccccccccgccagccccggccccttcgccaccagaagccccctgttcatcttcatgagaagaagcagcctgctgagcagaagcagcagcggctacttcagcttcgacaccgacagaagccccgcccccatgagctgcgacaagagcacccagacccccagccccccctgccaggccttcaaccactacctgagcgccatggccagcatgagacaggccgagcccgccgacatgagacccgagatctggatcgcccaggagctgagaagaatcggcgacgagttcaacgcctactacgccagaagagtgttcctgaacaactaccaggccgccgaggaccaccccagaatggtgatcctgagactgctgagatacatcgtgagactggtgtggagaatgcactag

SEQ ID NO: 9552 - DNA, 369 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccagggcaaccccgagggcaaccacggcggcgagggcgacagctgcccccacggcagcccccagggccccctggccccccccgccagccccggccccttcgccaccagaagccccctgttcatcttcatgagaagaagcagcctgctgagcagaagcagcagcggctacttcagcttcgacaccgacagaagccccgcccccatgagctgcgacaagagcacccagacccccagccccccctgccagtag

SEQ ID NO: 9553 - DNA, 222 bp, Artificial Sequence
  Description of Artificial Sequence: Synthetic coding sequence
atgagacaggccgagcccgccgacatgagacccgagatctggatcgcccaggagctgagaagaatcggcgacgagttcaacgcctactacgccagaagagtgatgatgttcagcctgcccgccttcctgctgacccccagccccagcaccctgtacttcttcaagaagaccgtgaccagctgcaactacatgctgatcctggagatgatcaccgtggcctag

SEQ ID NO: 9554 - DNA, 243 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccaggacagaagccccgcccccatgagctgcgacaagagcacccagacccccagccccccctgccaggccttcaaccactacctgagcgccatggtgagagagatcgaggaggtggtggtgtag

SEQ ID NO: 9555 - DNA, 408 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccagggcaaccccgagggcaaccacggcggcgagggcgacagctgcccccacggcagcccccagggccccctggccccccccgccagccccggccccttcgccaccagaagccccctgttcatcttcatgagaagaagcagcctgctgagcagaagcagcagcggctacttcagcttcgacaccgacagaagccccgcccccatgagctgcgacaagagcacccagacccccagccccccctgccaggccttcaaccactacctgagcgccatggccaactgggactag

SEQ ID NO: 9556 - DNA, 423 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccagggcaaccccgagggcaaccacggcggcgagggcgacagctgcccccacggcagcccccagggccccctggccccccccgccagccccggccccttcgccaccagaagccccctgttcatcttcatgagaagaagcagcctgctgagcagaagcagcagcggctacttcagcttcgacaccgacagaagccccgcccccatgagctgcgacaagagcacccagacccccagccccccctgccaggccttcaaccactacctgagcgccatggtgagagagatcgaggaggtggtggtgtag

SEQ ID NO: 9557 - DNA, 291 bp, Artificial Sequence
  Description of Artificial Sequence: Synthetic coding sequence
aagcagcccagcgacgtgagcagcgagtgcgacagagagggcagacagctgcagcccgccgagagacccccccagctgagacccggcgcccccaccagcctgcagaccgagccccaggacagaagccccgcccccatgagctgcgacaagagcacccagacccccagccccccctgccaggccttcaaccactacctgagcgccatggacgacagcgccggcagcagcctgagaatcgccctgcacagagaggtgcagtggcccctgaagtggctggccaagagcagctag

SEQ ID NO: 9558 - DNA, 249 bp, Artificial Sequence
  Description of Artificial Sequence: Synthetic coding sequence
atggccaagcagcccagcgacgtgagcagcgagtgcgacagagagggcagacagctgcagcccgccgagagacccccccagctgagacccggcgcccccaccagcctgcagaccgagccccaggccagcatgagacaggccgagcccgccgacatgagacccgagatctggatcgcccaggagctgagaagaatcggcgacgagttcaacgcctactacgccagaagaatgcccctgccccccgactag

SEQ ID NO: 9559 - DNA, 582 bp, Artificial Sequence
  Description of Artificial Sequence: Synthetic coding sequence
atggccacccccgccagcgcccccgacaccagagccctggtggccgacttcgtgggctacaagctgagacagaagggctacgtgtgcggcgccggccccggcgagggccccgccgccgaccccctgcaccaggccatgagagccgccggcgacgagttcgagaccagattcagaagaaccttcagcgacctggccgcccagctgcacgtgacccccggcagcgcccagcagagattcacccaggtgagcgacgagctgttccagggcggccccaactggggcagactggtggccttcttcgtgttcggcgccgccctgtgcgccgagagcgtgaacaaggagatggagcccctggtgggccaggtgcaggagtggatggtggcctacctggagacccagctggccgactggatccacagcagcggcggctgggccgagttcaccgccctgtacggcgacggcgccctggaggaggccagaagactgagagagggcaactgggccagcgtgagaaccgtgctgaccggcgccgtggccctgggcgccctggtgaccgtgggcgccttcttcgccagcaagtag

SEQ ID NO: 9560 - DNA, 156 bp, Artificial Sequence
  Description of Artificial Sequence: Synthetic coding sequence
atggccacccccgccagcgcccccgacaccagagccctggtggccgacttcgtgggctacaagctgagacagaagggctacgtgtgcggcgccggccccggcgagggccccgccgccgaccccctgcaccaggccatgagagccgccggcgactag

SEQ ID NO: 9561 - DNA, 219 bp, Artificial Sequence
  Description of Artificial Sequence: Synthetic coding sequence
atggccacccccgccagcgcccccgacaccagagccctggtggccgacttcgtgggctacaagctgagacagaagggctacgtgtgcggcgccggccccggcgagggccccgccgccgaccccctgcaccaggccatgagagccgccggcgacgagttcgagaccagattcagaagaaccttcagcgacctggccgcccagctgcacgtgaccccctag

SEQ ID NO: 9562 - DNA, 450 bp, Artificial Sequence
  Description of Artificial Sequence: Synthetic coding sequence
atggccacccccgccagcgcccccgacaccagagccctggtggccgacttcgtgggctacaagctgagacagaagggctacgtgtgcggcgccggccccggcgagggccccgccgccgaccccctgcaccaggccatgagagccgccggcgacgagttcgagaccagattcagaagaaccttcagcgacctggccgcccagctgcacgtgacccccggcagcgcccagcagagattcacccaggtgagcgacgagctgttccagggcggccccaactggggcagactggtggccttcttcgtgttcggcgccgccctgtgcgccgagagcgtgaacaaggagatggagcccctggtgggccaggtgcaggagtggatggtggcctacctggagacccagctggccgactggatccacagcagcggcggctgggccgagttcaccgcctag

SEQ ID NO: 9563 - DNA, 435 bp, Artificial Sequence
  Description of Artificial Sequence: Synthetic coding sequence
atggccacccccgccagcgcccccgacaccagagccctggtggccgacttcgtgggctacaagctgagacagaagggctacgtgtgcggcgccggccccggcgagggccccgccgccgaccccctgcaccaggccatgagagccgccggcgacgagttcgagaccagattcagaagaaccttcagcgacctggccgcccagctgcacgtgacccccggcagcgcccagcagagattcacccaggtgagcgacgagctgttccagggcggccccaactggggcagactggtggccttcttcgtgttcggcgccgccctgtgcgccgagagcgtgaacaaggagatggagcccctggtgggccaggtgcaggagtggatggtggcctacctggagacccagctggccgactggatccacagcagcggcggctggtag

SEQ ID NO: 9564 - DNA, 528 bp, Artificial Sequence
  Description of Artificial Sequence: Synthetic coding sequence
atgaccgactgcgagttcggctacatctacagactggcccaggactacctgcagtgcgtgctgcagatcccccagcccggcagcggccccagcaagaccagcagagtgctgcagaacgtggccttcagcgtgcagaaggaggtggagaagaacctgaagagctgcctggacaacgtgaacgtggtgagcgtggacaccgccagaaccctgttcaaccaggtgatggagaaggagttcgaggacggcatcatcaactggggcagaatcgtgaccatcttcgccttcgagggcatcctgatcaagaagctgctgagacagcagatcgcccccgacgtggacacctacaaggagatcagctacttcgtggccgagttcatcatgaacaacaccggcgagtggatcagacagaacggcggctgggagaacggcttcgtgaagaagttcgagcccaagagcggctggatgaccttcctggaggtgaccggcaagatctgcgagatgctgagcctgctgaagcagtactgctag

SEQ ID NO: 9565 - DNA, 492 bp, Artificial Sequence
  Description of Artificial Sequence: Synthetic coding sequence
atgaccgactgcgagttcggctacatctacagactggcccaggactacctgcagtgcgtgctgcagatcccccagcccggcagcggccccagcaagaccagcagagtgctgcagaacgtggccttcagcgtgcagaaggaggtggagaagaacctgaagagctgcctggacaacgtgaacgtggtgagcgtggacaccgccagaaccctgttcaaccaggtgatggagaaggagttcgaggacggcatcatcaactggggcagaatcgtgaccatcttcgccttcgagggcatcctgatcaagaagctgctgagacagcagatcgcccccgacgtggacacctacaaggagatcagctacttcgtggccgagttcatcatgaacaacaccggcgagtggatcagacagaacggcggctggggcaagtggcacaaccacacccccatgctggtggagagcgtggcccacaagaagagaaagatggccctgtag

SEQ ID NO: 9566 - DNA, 726 bp, Artificial Sequence
  Description of Artificial Sequence: Synthetic coding sequence
atgtgcagcggcgccggcgtgatgatggccagatgggccgccagaggcagagccggctggagaagcaccgtgagaatcctgagccccctgggccactgcgagcccggcgtgagcagaagctgcagagccgcccaggccatggactgcgaggtgaacaacggcagcagcctgagagacgagtgcatcaccaacctgctggtgttcggcttcctgcagagctgcagcgacaacagcttcagaagagagctggacgccctgggccacgagctgcccgtgctggccccccagtgggagggctacgacgagctgcagaccgacggcaacagaagcagccacagcagactgggcagaatcgaggccgacagcgagagccaggaggacatcatcagaaacatcgccagacacctggcccaggtgggcgacagcatggacagaagcatcccccccggcctggtgaacggcctggccctgcagctgagaaacaccagcagaagcgaggaggacagaaacagagacctggccaccgccctggagcagctgctgcaggcctaccccagagacatggagaaggagaagaccatgctggtgctggccctgctgctggccaagaaggtggccagccacacccccagcctgctgagagacgtgttccacaccaccgtgaacttcatcaaccagaacctgagaacctacgtgagaagcctggccagaaacggcatggactag

SEQ ID NO: 9567 - DNA, 414 bp, Artificial Sequence
  Description of Artificial Sequence: Synthetic coding sequence
atggactgcgaggtgaacaacggcagcagcctgagagacgagtgcatcaccaacctgctggtgttcggcttcctgcagagctgcagcgacaacagcttcagaagagagctggacgccctgggccacgagctgcccgtgctggccccccagtgggagggctacgacgagctgcagaccgacggcaacagaagcagccacagcagactgggcagaatcgaggccggcgccagcgacaacaacaccgccagcgccgaggaggagaccgaggccgccggcagcgtggccgtggagagaggcctgcacggcgccgccaccgtgatcctgaaggtgaagaagaccagcagcggcatcctgcccggcaccagccccagaagcggcaccgcctggaccgtggccagcctgagagcctggtag

SEQ ID NO: 9568 - DNA, 300 bp, Artificial Sequence
  Description of Artificial Sequence: Synthetic coding sequence
atggacagaagcatcccccccggcctggtgaacggcctggccctgcagctgagaaacaccagcagaagcgaggaggacagaaacagagacctggccaccgccctggagcagctgctgcaggcctaccccagagacatggagaaggagaagaccatgctggtgctggccctgctgctggccaagaaggtggccagccacacccccagcctgctgagagacgtgttccacaccaccgtgaacttcatcaaccagaacctgagaacctacgtgagaagcctggccagaaacggcatggactag

SEQ ID NO: 9569 - DNA, 300 bp, Artificial Sequence; identical to SEQ ID NO: 9568
  Description of Artificial Sequence: Synthetic coding sequence

SEQ ID NO: 9570 - DNA, 588 bp, Artificial Sequence
  Description of Artificial Sequence: Synthetic coding sequence
atggactgcgaggtgaacaacggcagcagcctgagagacgagtgcatcaccaacctgctggtgttcggcttcctgcagagctgcagcgacaacagcttcagaagagagctggacgccctgggccacgagctgcccgtgctggccccccagtgggagggctacgacgagctgcagaccgacggcaacagaagcagccacagcagactgggcagaatcgaggccgacagcgagagccaggaggacatcatcagaaacatcgccagacacctggcccaggtgggcgacagcatggacagaagcatcccccccggcctggtgaacggcctggccctgcagctgagaaacaccagcagaagcgaggaggacagaaacagagacctggccaccgccctggagcagctgctgcaggcctaccccagagacatggagaaggagaagaccatgctggtgctggccctgctgctggccaagaaggtggccagccacacccccagcctgctgagagacgtgttccacaccaccgtgaacttcatcaaccagaacctgagaacctacgtgagaagcctggccagaaacggcatggactag

SEQ ID NO: 9571 - DNA, 588 bp, Artificial Sequence; identical to SEQ ID NO: 9570
  Description of Artificial Sequence: Synthetic coding sequence

SEQ ID NO: 9572 - DNA, 1353 bp, Artificial Sequence
  Description of Artificial Sequence: Synthetic coding sequence
atggaggagccccagaagagctacgtgaacaccatggacctggagagagacgagcccctgaagagcaccggcccccagatcagcgtgagcgagttcagctgccactgctgctacgacatcctggtgaaccccaccaccctgaactgcggccacagcttctgcagacactgcctggccctgtggtgggccagcagcaagaagaccgagtgccccgagtgcagagagaagtgggagggcttccccaaggtgagcatcctgctgagagacgccatcgagaagctgttccccgacgccatcagactgagattcgaggacatccagcagaacaacgacatcgtgcagagcctggccgccttccagaagtacggcaacgaccagatccccctggcccccaacaccggcagagccaaccagcagatgggcggcggcttcttcagcggcgtgctgaccgccctgaccggcgtggccgtggtgctgctggtgtaccactggagcagcagagagagcgagcacgacctgctggtgcacaaggccgtggccaagtggaccgccgaggaggtggtgctgtggctggagcagctgggcccctgggccagcctgtacagagagagattcctgagcgagagagtgaacggcagactgctgctgaccctgaccgaggaggagttcagcaagaccccctacaccatcgagaacagcagccacagaagagccatcctgatggagctggagagagtgaaggccctgggcgtgaagcccccccagaacctgtgggagtacaaggccgtgaaccccggcagaagcctgttcctgctgtacgccctgaagagcagccccagactgagcctgctgtacctgtacctgttcgactacaccgacaccttcctgcccttcatccacaccatctgccccctgcaggaggacagcagcggcgaggacatcgtgaccaagctgctggacctgaaggagcccacctggaagcagtggagagagttcctggtgaagtacagcttcctgccctaccagctgatcgccgagttcgcctgggactggctggaggtgcactactggaccagcagattcctgatcatcaacgccatgctgctgagcgtgctggagctgttcagcttctggagaatctggagcagaagcgagctgaagaccgtgccccagagaatgtggagccacttctggaaggtgagcacccagggcctgttcgtggccatgttctggcccctgatcccccagttcgtgtgcaactgcctgttctactgggccctgtacttcaaccccatcatcaacatcgacctggtggtgaaggagctgagaagactggagacccaggtgctgtag

SEQ ID NO: 9573 - DNA, 969 bp, Artificial Sequence
  Description of Artificial Sequence: Synthetic coding sequence
atggtgggcatcttcaaggagaacagaatgagcagaatgcagagaaagatgggcagattcccccagagccagtacagcccccaggtggtgctgctggtgtaccactggagcagcagagagagcgagcacgacctgctggtgcacaaggccgtggccaagtggaccgccgaggaggtggtgctgtggctggagcagctgggcccctgggccagcctgtacagagagagattcctgagcgagagagtgaacggcagactgctgctgaccctgaccgaggaggagttcagcaagaccccctacaccatcgagaacagcagccacagaagagccatcctgatggagctggagagagtgaaggccctgggcgtgaagcccccccagaacctgtgggagtacaaggccgtgaaccccggcagaagcctgttcctgctgtacgccctgaagagcagccccagactgagcctgctgtacctgtacctgttcgactacaccgacaccttcctgcccttcatccacaccatctgccccctgcaggaggacagcagcggcgaggacatcgtgaccaagctgctggacctgaaggagcccacctggaagcagtggagagagttcctggtgaagtacagcttcctgccctaccagctgatcgccgagttcgcctgggactggctggaggtgcactactggaccagcagattcctgatcatcaacgccatgctgctgagcgtgctggagctgttcagcttctggagaatctggagcagaagcgagctgaagaccgtgccccagagaatgtggagccacttctggaaggtgagcacccagggcctgttcgtggccatgttctggcccctgatcccccagttcgtgtgcaactgcctgttctactgggccctgtacttcaaccccatcatcaacatcgacctggtggtgaaggagctgagaagactggagacccaggtgctgtag

SEQ ID NO: 9574 - DNA, 4254 bp, Artificial Sequence
  Description of Artificial Sequence: Synthetic coding sequence
atggccgccgtgccccagaacaacctgcaggagcagctggagagacacagcgccagaaccctgaacaacaagctgagcctgagcaagcccaagttcagcggcttcaccttcaagaagaagaccagcagcgacaacaacgtgagcgtgaccaacgtgagcgtggccaagacccccgtgctgagaaacaaggacgtgaacgtgaccgaggacttcagcttcagcgagcccctgcccaacaccaccaaccagcagagagtgaaggacttcttcaagaacgcccccgccggccaggagacccagagaggcggcagcaagagcctgctgcccgacttcctgcagacccccaaggaggtggtgtgcaccacccagaacacccccaccgtgaagaagagcagagacaccgccctgaagaagctggagttcagcagcagccccgacagcctgagcaccatcaacgactgggacgacatggacgacttcgacaccagcgagaccagcaagagcttcgtgacccccccccagagccacttcgtgagagtgagcaccgcccagaagagcaagaagggcaagagaaacttcttcaaggcccagctgtacaccaccaacaccgtgaagaccgacctgcccccccccagcagcgagagcgagcagatcgacctgaccgaggagcagaaggacgacagcgagtggctgagcagcgacgtgatctgcatcgacgacggccccatcgccgaggtgcacatcaacgaggacgcccaggagagcgacagcctgaagacccacctggaggacgagagagacaacagcgagaagaagaagaacctggaggaggccgagctgcacagcaccgagaaggtgccctgcatcgagttcgacgacgacgactacgacaccgacttcgtgccccccagccccgaggagatcatcagcgccagcagcagcagcagcaagtgcctgagcaccctgaaggacctggacaccagcgacagaaaggaggacgtgctgagcaccagcaaggacctgctgagcaagcccgagaagatgagcatgcaggagctgaaccccgagaccagcaccgactgcgacgccagacagatcagcctgcagcagcagctgatccacgtgatggagcacatctgcaagctgatcgacaccatccccgacgacaagctgaagctgctggactgcggcaacgagctgctgcagcagagaaacatcagaagaaagctgctgaccgaggtggacttcaacaagagcgacgccagcctgctgggcagcctgtggagatacagacccgacagcctggacggccccatggagggcgacagctgccccaccggcaacagcatgaaggagctgaacttcagccacctgcccagcaacagcgtgagccccggcgactgcctgctgaccaccaccctgggcaagaccggcttcagcgccaccagaaagaacctgttcgagagacccctgttcaacacccacctgcagaagagcttcgtgagcagcaactgggccgagacccccagactgggcaagaagaacgagagcagctacttccccggcaacgtgctgaccagcaccgccgtgaaggaccagaacaagcacaccgccagcatcaacgacctggagagagagacccagcccagctacgacatcgacaacttcgacatcgacgacttcgacgacgacgacgactgggaggacatcatgcacaacctggccgccagcaagagcagcaccgccgcctaccagcccatcaaggagggcagacccatcaagagcgtgagcgagagactgagcagcgccaagaccgactgcctgcccgtgagcagcaccgcccagaacatcaacttcagcgagagcatccagaactacaccgacaagagcgcccagaacctggccagcagaaacctgaagcacgagagattccagagcctgagcttcccccacaccaaggagatgatgaagatcttccacaagaagttcggcctgcacaacttcagaaccaaccagctggaggccatcaacgccgccctgctgggcgaggactgcttcatcctgatgcccaccggcggcggcaagagcctgtgctaccagctgcccgcctgcgtgagccccggcgtgaccgtggtgatcagccccctgagaagcctgatcgtggaccaggtgcagaagctgaccagcctggacatccccgccacctacctgaccggcgacaagaccgacagcgaggccaccaacatctacctgcagctgagcaagaaggaccccatcatcaagctgctgtacgtgacccccgagaagatctgcgccagcaacagactgatcagcaccctggagaacctgtacgagagaaagctgctggccagattcgtgatcgacgaggcccactgcgtgagccagtggggccacgacttcagacaggactacaagagaatgaacatgctgagacagaagttccccagcgtgcccgtgatggccctgaccgccaccgccaaccccagagtgcagaaggacatcctgacccagctgaagatcctgagaccccaggtgttcagcatgagcttcaacagacacaacctgaagtactacgtgctgcccaagaagcccaagaaggtggccttcgactgcctggagtggatcagaaagcaccacccctacgacagcggcatcatctactgcctgagcagaagagagtgcgacaccatggccgacaccctgcagagagacggcctggccgccctggcctaccacgccggcctgagcgacagcgccagagacgaggtgcagcagaagtggatcaaccaggacggctgccaggtgatctgcgccaccatcgccttcggcatgggcatcgacaagcccgacgtgagattcgtgatccacgccagcctgcccaagagcgtggagggctactaccaggagagcggcagagccggcagagacggcgagatcagccactgcctgctgttctacacctaccacgacgtgaccagactgaagagactgatcatgatggagaaggacggcaaccaccacaccagagagacccacttcaacaacctgtacagcatggtgcactactgcgagaacatcaccgagtgcagaagaatccagctgctggcctacttcggcgagaacggcttcaaccccgacttctgcaagaagcaccccgacgtgagctgcgacaactgctgcaagaccaaggactacaagaccagagacgtgaccgacgacgtgaagagcatcgtgagattcgtgcaggagcacagcagcagccagggcatgagaaacatcaagcacgtgggccccagcggcagattcaccatgaacatgctggtggacatcttcctgggcagcaagagcgccaagatccagagcggcatcttcggcaagggcagcgcctacagcagacacaacgccgagagactgttcaagaagctgatcctggacaagatcctggacgaggacctgtacatcaacgccaacgaccaggccatcgcctacgtgatgctgggcaacaaggcccagaccgtgctgaacggcaacctgaaggtggacttcatggagaccgagaacagcagcagcgtgaagaagcagaaggccctggtggccaaggtgagccagagagaggagatggtgaagaagtgcctgggcgagctgaccgaggtgtgcaagagcctgggcaaggtgttcggcgtgcactacttcaacatcttcaacaccgtgaccctgaagaagctggccgagagcctgagcagcgaccccgaggtgctgctgcagatcgacggcgtgaccgaggacaagctggagaagtacggcgccgaggtgatcagcgtgctgcagaagtacagcgagtggaccagccccgccgaggacagcagccccggcatcagcctgagcagcagcagaggccccggcagaagcgccgccgaggagctggacgaggagatccccgtgagcagccactacttcgccagcaagaccagaaacgagagaaagagaaagaagatgcccgccagccagagaagcaagagaagaaagaccgccagcagcggcagcaaggccaagggcggcagcgccacctgcagaaagatcagcagcaagaccaagagcagcagcatcatcggcagcagcagcgccagccacaccagccaggccaccagcggcgccaacagcaagctgggcatcatggccccccccaagcccatcaacagacccttcctgaagcccagctacgccttcagctag

SEQ ID NO: 9575 - DNA, 3144 bp, Artificial Sequence
  Description of Artificial Sequence: Synthetic coding sequence
atgagcatgcaggagctgaaccccgagaccagcaccgactgcgacgccagacagatcagcctgcagcagcagctgatccacgtgatggagcacatctgcaagctgatcgacaccatccccgacgacaagctgaagctgctggactgcggcaacgagctgctgcagcagagaaacatcagaagaaagctgctgaccgaggtggacttcaacaagagcgacgccagcctgctgggcagcctgtggagatacagacccgacagcctggacggccccatggagggcgacagctgccccaccggcaacagcatgaaggagctgaacttcagccacctgcccagcaacagcgtgagccccggcgactgcctgctgaccaccaccctgggcaagaccggcttcagcgccaccagaaagaacctgttcgagagacccctgttcaacacccacctgcagaagagcttcgtgagcagcaactgggccgagacccccagactgggcaagaagaacgagagcagctacttccccggcaacgtgctgaccagcaccgccgtgaaggaccagaacaagcacaccgccagcatcaacgacctggagagagagacccagcccagctacgacatcgacaacttcgacatcgacgacttcgacgacgacgacgactgggaggacatcatgcacaacctggccgccagcaagagcagcaccgccgcctaccagcccatcaaggagggcagacccatcaagagcgtgagcgagagactgagcagcgccaagaccgactgcctgcccgtgagcagcaccgcccagaacatcaacttcagcgagagcatccagaactacaccgacaagagcgcccagaacctggccagcagaaacctgaagcacgagagattccagagcctgagcttcccccacaccaaggagatgatgaagatcttccacaagaagttcggcctgcacaacttcagaaccaaccagctggaggccatcaacgccgccctgctgggcgaggactgcttcatcctgatgcccaccggcggcggcaagagcctgtgctaccagctgcccgcctgcgtgagccccggcgtgaccgtggtgatcagccccctgagaagcctgatcgtggaccaggtgcagaagctgaccagcctggacatccccgccacctacctgaccggcgacaagaccgacagcgaggccaccaacatctacctgcagctgagcaagaaggaccccatcatcaagctgctgtacgtgacccccgagaagatctgcgccagcaacagactgatcagcaccctggagaacctgtacgagagaaagctgctggccagattcgtgatcgacgaggcccactgcgtgagccagtggggccacgacttcagacaggactacaagagaatgaacatgctgagacagaagttccccagcgtgcccgtgatggccctgaccgccaccgccaaccccagagtgcagaaggacatcctgacccagctgaagatcctgagaccccaggtgttcagcatgagcttcaacagacacaacctgaagtactacgtgctgcccaagaagcccaagaaggtggccttcgactgcctggagtggatcagaaagcaccacccctacgacagcggcatcatctactgcctgagcagaagagagtgcgacaccatggccgacaccctgcagaagtggatcaaccaggacggctgccaggtgatctgcgccaccatcgccttcggcatgggcatcgacaagcccgacgtgagattcgtgatccacgccagcctgcccaagagcgtggagggctactaccaggagagcggcagagccggcagagacggcgagatcagccactgcctgctgttctacacctaccacgacgtgaccagactgaagagactgatcatgatggagaaggacggcaaccaccacaccagagagacccacttcaacaacctgtacagcatggtgcactactgcgagaacatcaccgagtgcagaagaatccagctgctggcctacttcggcgagaacggcttcaaccccgacttctgcaagaagcaccccgacgtgagctgcgacaactgctgcaagaccaaggactacaagaccagagacgtgaccgacgacgtgaagagcatcgtgagattcgtgcaggagcacagcagcagccagggcatgagaaacatcaagcacgtgggccccagcggcagattcaccatgaacatgctggtggacatcttcctgggcagcaagagcgccaagatccagagcggcatcttcggcaagggcagcgcctacagcagacacaacgccgagagactgttcaagaagctgatcctggacaagatcctggacgaggacctgtacatcaacgccaacgaccaggccatcgcctacgtgatgctgggcaacaaggcccagaccgtgctgaacggcaacctgaaggtggacttcatggagaccgagaacagcagcagcgtgaagaagcagaaggccctggtggccaaggtgagccagagagaggagatggtgaagaagtgcctgggcgagctgaccgaggtgtgcaagagcctgggcaaggtgttcggcgtgcactacttcaacatcttcaacaccgtgaccctgaagaagctggccgagagcctgagcagcgaccccgaggtgctgctgcagatcgacggcgtgaccgaggacaagctggagaagtacggcgccgaggtgatcagcgtgctgcagaagtacagcgagtggaccagccccgccgaggacagcagccccggcatcagcctgagcagcagcagaggccccggcagaagcgccgccgaggagctggacgaggagatccccgtgagcagccactacttcgccagcaagaccagaaacgagagaaagagaaagaagatgcccgccagccagagaagcaagagaagaaagaccgccagcagcggcagcaaggccaagggcggcagcgccacctgcagaaagatcagcagcaagaccaagagcagcagcatcatcggcagcagcagcgccagccacaccagccaggccaccagcggcgccaacagcaagctgggcatcatggccccccccaagcccatcaacagacccttcctgaagcccagctacgccttcagctag

SEQ ID NO: 9576 - DNA, 1560 bp, Artificial Sequence
  Description of Artificial Sequence: Synthetic coding sequence
atgaacatgctgagacagaagttccccagcgtgcccgtgatggccctgaccgccaccgccaaccccagagtgcagaaggacatcctgacccagctgaagatcctgagaccccaggtgttcagcatgagcttcaacagacacaacctgaagtactacgtgctgcccaagaagcccaagaaggtggccttcgactgcctggagtggatcagaaagcaccacccctacgacagcggcatcatctactgcctgagcagaagagagtgcgacaccatggccgacaccctgcagagagacggcctggccgccctggcctaccacgccggcctgagcgacagcgccagagacgaggtgcagcagaagtggatcaaccaggacggctgccaggtgatctgcgccaccatcgccttcggcatgggcatcgacaagcccgacgtgagattcgtgatccacgccagcctgcccaagagcgtggagggctactaccaggagagcggcagagccggcagagacggcgagatcagccactgcctgctgttctacacctaccacgacgtgaccagactgaagagactgatcatgatggagaaggacggcaaccaccacaccagagagacccacttcaacaacctgtacagcatggtgcactactgcgagaacatcaccgagtgcagaagaatccagctgctggcctacttcggcgagaacggcttcaaccccgacttctgcaagaagcaccccgacgtgagctgcgacaactgctgcaagaccaaggactacaagaccagagacgtgaccgacgacgtgaagagcatcgtgagattcgtgcaggagcacagcagcagccagggcatgagaaacatcaagcacgtgggccccagcggcagattcaccatgaacatgctggtggacatcttcctgggcagcaagagcgccaagatccagagcggcatcttcggcaagggcagcgcctacagcagacacaacgccgagagactgttcaagaagctgatcctggacaagatcctggacgaggacctgtacatcaacgccaacgaccaggccatcgcctacgtgatgctgggcaacaaggcccagaccgtgctgaacggcaacctgaaggtggacttcatggagaccgagaacagcagcagcgtgaagaagcagaaggccctggtggccaaggtgagccagagagaggagatggtgaagaagtgcctgggcgagctgaccgaggtgtgcaagagcctgggcaaggtgttcggcgtgcactacttcaacatcttcaacaccgtgaccctgaagaagctggccgagagcctgagcagcgaccccgaggtgctgctgcagatcgacggcgtgaccgaggacaagctggagaagtacggcgccgaggtgatcagcgtgctgcagaagtacagcgagtggaccagccccgccgaggacagcagccccggcatcagcctgagcagcagcagaggccccggcagaagcgccgccgaggagctggacgaggagatccccgtgagcagccactacttcgccagcaagaccagaaactag

SEQ ID NO: 9577 - DNA, 981 bp, Artificial Sequence
  Description of Artificial Sequence: Synthetic coding sequence
atgcacagaaccaccagaatcaagatcaccgagctgaacccccacctgatgtgcgtgctgtgcggcggctacttcatcgacgccaccaccatcatcgagtgcctgcacagcttctgcaagacctgcatcgtgagatacctggagaccagcaagtactgccccatctgcgacgtgcaggtgcacaagaccagacccctgctgaacatcagaagcgacaagaccctgcaggacatcgtgtacaagctggtgcccggcctgttcaagaacgagatgaagagaagaagagacttctacgccgcccaccccagcgccgacgccgccaacggcagcaacgaggacagaggcgaggtggccgacgaggacaagagaatcatcaccgacgacgagatcatcagcctgagcatcgagttcttcgaccagaacagactggacagaaaggtgaacaaggacaaggagaagagcaaggaggaggtgaacgacaagagatacctgagatgccccgccgccatgaccgtgatgcacctgagaaagttcctgagaagcaagatggacatccccaacaccttccagatcgacgtgatgtacgaggaggagcccctgaaggactactacaccctgatggacatcgcctacatctacacctggagaagaaacggccccctgcccctgaagtacagagtgagacccacctgcaagagaatgaagatcagccaccagagagacggcctgaccaacgccggcgagctggagagcgacagcggcagcgacaaggccaacagccccgccggcggcatccccagcaccagcagctgcctgcccagccccagcacccccgtgcagagcccccacccccagttcccccacatcagcagcaccatgaacggcaccagcaacagccccagcggcaaccaccagagcagcttcgccaacagacccagaaagagcagcgtgaacggcagcagcgccaccagcagcggctag

SEQ ID NO: 9578 - DNA, 717 bp, Artificial Sequence
  Description of Artificial Sequence: Synthetic coding sequence
atgtgcgtgctgtgcggcggctacttcatcgacgccaccaccatcatcgagtgcctgcacagcttctgcaagacctgcatcgtgagatacctggagaccagcaagtactgccccatctgcgacgtgcaggtgcacaagaccagacccctgctgaacatcagactggacagaaaggtgaacaaggacaaggagaagagcaaggaggaggtgaacgacaagagatacctgagatgccccgccgccatgaccgtgatgcacctgagaaagttcctgagaagcaagatggacatccccaacaccttccagatcgacgtgatgtacgaggaggagcccctgaaggactactacaccctgatggacatcgcctacatctacacctggagaagaaacggccccctgcccctgaagtacagagtgagacccacctgcaagagaatgaagatcagccaccagagagacggcctgaccaacgccggcgagctggagagcgacagcggcagcgacaaggccaacagccccgccggcggcatccccagcaccagcagctgcctgcccagccccagcacccccgtgcagagcccccacccccagttcccccacatcagcagcaccatgaacggcaccagcaacagccccagcggcaaccaccagagcagcttcgccaacagacccagaaagagcagcgtgaacggcagcagcgccaccagcagcggctag

SEQ ID NO: 9579 - DNA, 318 bp, Artificial Sequence
  Description of Artificial Sequence: Synthetic coding sequence
atgcacagaaccaccagaatcaagatcaccgagctgaacccccacctgatgtgcgtgctgtgcggcggctacttcatcgacgccaccaccatcatcgagtgcctgcacagcttctgcaagacctgcatcgtgagatacctggagaccagcaagtactgccccatctgcgacgtgcaggtgcacaagaccagacccctgctgaacatcagaagcgacaagaccctgcaggacatcgtgtacaagctggtgcccggcctgttcaagaacgagatgaagagaagaagagacttctacgccgcccaccccagcgccgactag

SEQ ID NO: 9580 - DNA, 624 bp, Artificial Sequence
  Description of Artificial Sequence: Synthetic coding sequence
atgcacagaaccaccagaatcaagatcaccgagctgaacccccacctgatgtgcgtgctgtgcggcggctacttcatcgacgccaccaccatcatcgagtgcctgcacagcttctgcaagacctgcatcgtgagatacctggagaccagcaagtactgccccatctgcgacgtgcaggtgcacaagaccagacccctgctgaacatcagaagcgacaagaccctgcaggacatcgtgtacaagctggtgcccggcctgttcaagaacgagatgaagagaagaagagacttctacgccgcccaccccagcgccgacgccgccaacggcagcaacgaggacagaggcgaggtggccgacgaggacaagagaatcatcaccgacgacgagatcatcagcctgagcatcgagttcttcgaccagaacagactggacagaaaggtgaacaaggacaaggagaagagcaaggaggaggtgaacgacaagagatacctgagatgccccgccgccatgaccgtgatgcacctgagaaagttcctgagaagcaagatggacatccccaacaccttccagatcgacgtgatgtacgaggaggagcccctgaaggactactacaccctgatgtag

SEQ ID NO: 9581 - DNA, 453 bp, Artificial Sequence
  Description of Artificial Sequence: Synthetic coding sequence
atgcacagaaccaccagaatcaagatcaccgagctgaacccccacctgatgtgcgtgctgtgcggcggctacttcatcgacgccaccaccatcatcgagtgcctgcacagcttctgcaagacctgcatcgtgagatacctggagaccagcaagtactgccccatctgcgacgtgcaggtgcacaagaccagacccctgctgaacatcagaagcgacaagaccctgcaggacatcgtgtacaagctggtgcccggcctgttcaagaacgagatgaagagaagaagagacttctacgccgcccaccccagcgccgacgccgccaacggcagcaacgaggacagaggcgaggtggccgacgaggacaagagaatcatcaccgacgacgagatcatcagcctgagcatcgagttcttcgaccagaacagactggacagaaaggtgaacaaggactag

SEQ ID NO: 9582 - DNA, 555 bp, Artificial Sequence
  Description of Artificial Sequence: Synthetic coding sequence
tacttcatcgacgccaccaccatcatcgagtgcctgcacagcttctgcaagacctgcatcgtgagatacctggagaccagcaagtactgccccatctgcgacgtgcaggtgcacaagaccagacccctgctgaacatcagactggacagaaaggtgaacaaggacaaggagaagagcaaggaggaggtgaacgacaagagatacctgagatgccccgccgccatgaccgtgatgcacctgagaaagttcctgagaagcaagatggacatccccaacaccttccagatcgacgtgatgtacgaggaggagcccctgaaggactactacaccctgatggacatcgcctacatctacacctggagaagaaacggccccctgcccctgaagtacagagtgagacccacctgcaagagaatgaagatcagccaccagagagacggcctgaccaacgccggcgagctggagagcgacagcggcagcgacaaggccaacagccccgccggcggcatccccagcaccagcagctgcctgcccagccccagcacccccgtgtag

SEQ ID NO: 9583 - DNA, 279 bp, Artificial Sequence
  Description of Artificial Sequence: Synthetic coding sequence
atgcacagaaccaccagaatcaagatcaccgagctgaacccccacctgatgtgcgtgctgtgcggcggctacttcatcgacgccaccaccatcatcgagtgcctgcacagcttctgcaagacctgcatcgtgagatacctggagaccagcaagtactgccccatctgcgacgtgcaggtgcacaagaccagacccctgctgaacatcagaagcgacaagaccctgcaggacatcgtgtacaagctggtgcccggcctgttcaccgccaacggcagctag

SEQ ID NO: 9584 - DNA, 2193 bp, Artificial Sequence
  Description of Artificial Sequence: Synthetic coding sequence
atgcccggcgtggccagactgcccctgctgctgggcctgctgctgctgcccagacccggcagacccctggacctggccgactacacctacgacctggccgaggaggacgacagcgagcccctgaactacaaggacccctgcaaggccgccgccttcctgggcgacatcgccctggacgaggaggacctgagagccttccaggtgcagcaggccgtggacctgagaagacacaccgccagaaagagcagcatcaaggccgccgtgcccggcaacaccagcacccccagctgccagagcaccaacggccagccccagagaggcgcctgcggcagatggagaggcagaagcagaagcagaagagccgccaccagcagacccgagagagtgtggcccgacggcgtgatccccttcgtgatcggcggcaacttcaccggcagccagagagccgtgttcagacaggccatgagacactgggagaagcacacctgcgtgaccttcctggagagaaccgacgaggacagctacatcgtgttcacctacagaccctgcggctgctgcagctacgtgggcagaagaggcggcggcccccaggccatcagcatcggcaagaactgcgacaagttcggcatcgtggtgcacgagctgggccacgtggtgggcttctggcacgagcacaccagacccgacagagacagacacgtgagcatcgtgagagagaacatccagcccggccaggagtacaacttcctgaagatggagccccaggaggtggagagcctgggcgagacctacgacttcgacagcatcatgcactacgccagaaacaccttcagcagaggcatcttcctggacaccatcgtgcccaagtacgaggtgaacggcgtgaagccccccatcggccagagaaccagactgagcaagggcgacatcgcccaggccagaaagctgtacaagtgccccgcctgcggcgagaccctgcaggacagcaccggcaacttcagcagccccgagtaccccaacggctacagcgcccacatgcactgcgtgtggagaatcagcgtgacccccggcgagaagatcatcctgaacttcaccagcctggacctgtacagaagcagactgtgctggtacgactacgtggaggtgagagacggcttctggagaaaggcccccctgagaggcagattctgcggcagcaagctgcccgagcccatcgtgagcaccgacagcagactgtgggtggagttcagaagcagcagcaactgggtgggcaagggcttcttcgccgtgtacgaggccatctgcggcggcgacgtgaagaaggactacggccacatccagagccccaactaccccgacgactacagacccagcaaggtgtgcatctggagaatccaggtgagcgagggcttccacgtgggcctgaccttccagagcttcgagatcgagagacacgacagctgcgcctacgactacctggaggtgagagacggccacagcgagagcagcaccctgatcggcagatactgcggctacgagaagcccgacgacatcaagagcaccagcagcagactgtggctgaagttcgtgagcgacggcagcatcaacaaggccggcttcgccgtgaacttcttcaaggaggtggacgagtgcagcagacccaacagaggcggctgcgagcagagatgcctgaacaccctgggcagctacaagtgcagctgcgaccccggctacgagctggcccccgacaagagaagatgcgaggccgcctgcggcggcttcctgaccaagctgaacggcagcatcaccagccccggctggcccaaggagtacccccccaacaagaactgcatctggcagctggtggcccccacccagtacagaatcagcctgcagttcgacttcttcgagaccgagggcaacgacgtgtgcaagtacgacttcgtggaggtgagaagcggcctgaccgccgacagcaagctgcacggcaagttctgcggcagcgagaagcccgaggtgatcaccagccagtacaacaacatgagagtggagttcaagagcgacaacaccgtgagcaagaagggcttcaaggcccacttcttcagcgagaagagacccgccctgcagccccccagaggcagaccccaccagctgaagttcagagtgcagaagagaaacagaaccccccagtag

SEQ ID NO: 9585 - DNA, 2961 bp, Artificial Sequence
  Description of Artificial Sequence: Synthetic coding sequence
atgcccggcgtggccagactgcccctgctgctgggcctgctgctgctgcccagacccggcagacccctggacctggccgactacacctacgacctggccgaggaggacgacagcgagcccctgaactacaaggacccctgcaaggccgccgccttcctgggcgacatcgccctggacgaggaggacctgagagccttccaggtgcagcaggccgtggacctgagaagacacaccgccagaaagagcagcatcaaggccgccgtgcccggcaacaccagcacccccagctgccagagcaccaacggccagccccagagaggcgcctgcggcagatggagaggcagaagcagaagcagaagagccgccaccagcagacccgagagagtgtggcccgacggcgtgatccccttcgtgatcggcggcaacttcaccggcagccagagagccgtgttcagacaggccatgagacactgggagaagcacacctgcgtgaccttcctggagagaaccgacgaggacagctacatcgtgttcacctacagaccctgcggctgctgcagctacgtgggcagaagaggcggcggcccccaggccatcagcatcggcaagaactgcgacaagttcggcatcgtggtgcacgagctgggccacgtggtgggcttctggcacgagcacaccagacccgacagagacagacacgtgagcatcgtgagagagaacatccagcccggccaggagtacaacttcctgaagatggagccccaggaggtggagagcctgggcgagacctacgacttcgacagcatcatgcactacgccagaaacaccttcagcagaggcatcttcctggacaccatcgtgcccaagtacgaggtgaacggcgtgaagccccccatcggccagagaaccagactgagcaagggcgacatcgcccaggccagaaagctgtacaagtgccccgcctgcggcgagaccctgcaggacagcaccggcaacttcagcagccccgagtaccccaacggctacagcgcccacatgcactgcgtgtggagaatcagcgtgacccccggcgagaagatcatcctgaacttcaccagcctggacctgtacagaagcagactgtgctggtacgactacgtggaggtgagagacggcttctggagaaaggcccccctgagaggcagattctgcggcagcaagctgcccgagcccatcgtgagcaccgacagcagactgtgggtggagttcagaagcagcagcaactgggtgggcaagggcttcttcgccgtgtacgaggccatctgcggcggcgacgtgaagaaggactacggccacatccagagccccaactaccccgacgactacagacccagcaaggtgtgcatctggagaatccaggtgagcgagggcttccacgtgggcctgaccttccagagcttcgagatcgagagacacgacagctgcgcctacgactacctggaggtgagagacggccacagcgagagcagcaccctgatcggcagatactgcggctacgagaagcccgacgacatcaagagcaccagcagcagactgtggctgaagttcgtgagcgacggcagcatcaacaaggccggcttcgccgtgaacttcttcaaggaggtggacgagtgcagcagacccaacagaggcggctgcgagcagagatgcctgaacaccctgggcagctacaagtgcagctgcgaccccggctacgagctggcccccgacaagagaagatgcgaggccgcctgcggcggcttcctgaccaagctgaacggcagcatcaccagccccggctggcccaaggagtacccccccaacaagaactgcatctggcagctggtggcccccacccagtacagaatcagcctgcagttcgacttcttcgagaccgagggcaacgacgtgtgcaagtacgacttcgtggaggtgagaagcggcctgaccgccgacagcaagctgcacggcaagttctgcggcagcgagaagcccgaggtgatcaccagccagtacaacaacatgagagtggagttcaagagcgacaacaccgtgagcaagaagggcttcaaggcccacttcttcagcgacaaggacgagtgcagcaaggacaacggcggctgccagcaggactgcgtgaacaccttcggcagctacgagtgccagtgcagaagcggcttcgtgctgcacgacaacaagcacgactgcaaggaggccggctgcgaccacaaggtgaccagcaccagcggcaccatcaccagccccaactggcccgacaagtaccccagcaagaaggagtgcacctgggccatcagcagcacccccggccacagagtgaagctgaccttcatggagatggacatcgagagccagcccgagtgcgcctacgaccacctggaggtgttcgacggcagagacgccaaggcccccgtgctgggcagattctgcggcagcaagaagcccgagcccgtgctggccaccggcagcagaatgttcctgagattctacagcgacaacagcgtgcagagaaagggcttccaggccagccacgccaccgagtgcggcggccaggtgagagccgacgtgaagaccaaggacctgtacagccacgcccagttcggcgacaacaactaccccggcggcgtggactgcgagtgggtgatcgtggccgaggagggctacggcgtggagctggtgttccagaccttcgaggtggaggaggagaccgactgcggctacgactacatggagctgttcgacggctacgacagcaccgcccccagactgggcagatactgcggcagcggcccccccgaggaggtgtacagcgccggcgacagcgtgctggtgaagttccacagcgacgacaccatcaccaagaagggcttccacctgagatacaccagcaccaagttccaggacaccctgcacagcagaaagtag

SEQ ID NO: 9586 - DNA, 909 bp, Artificial Sequence
  Description of Artificial Sequence: Synthetic coding sequence
atgcccggcgtggccagactgcccctgctgctgggcctgctgctgctgcccagacccggcagacccctggacctggccgactacacctacgacctggccgaggaggacgacagcgagcccctgaactacaaggacccctgcaaggccgccgccttcctgggcgacatcgccctggacgaggaggacctgagagccttccaggtgcagcaggccgtggacctgagaagacacaccgccagaaagagcagcatcaaggccgccgtgcccggcaacaccagcacccccagctgccagagcaccaacggccagccccagagaggcgcctgcggcagatggagaggcagaagcagaagcagaagagccgccaccagcagacccgagagagtgtggcccgacggcgtgatccccttcgtgatcggcggcaacttcaccggcagccagagagccgtgttcagacaggccatgagacactgggagaagcacacctgcgtgaccttcctggagagaaccgacgaggacagctacatcgtgttcacctacagaccctgcggctgctgcagctacgtgggcagaagaggcggcggcccccaggccatcagcatcggcaagaactgcgacaagttcggcatcgtggtgcacgagctgggccacgtggtgggcttctggcacgagcacaccagacccgacagagacagacacgtgagcatcgtgagagagaacatccagcccggcgtgctgcacagcagcctgctgctgctgagctgcggcagcagaaacggcgccagcttcccctgcagcctggagagcagcatccaccaggccctgtgctggaccggcctgttcctgagacccagccccttccccagactgcccctggccgcccccagaaccctgagagccggcgtgtag

SEQ ID NO: 9587 - DNA, 1869 bp, Artificial Sequence
  Description of Artificial Sequence: Synthetic coding sequence
atgcccggcgtggccagactgcccctgctgctgggcctgctgctgctgcccagacccggcagacccctggacctggccgactacacctacgacctggccgaggaggacgacagcgagcccctgaactacaaggacccctgcaaggccgccgccttcctgggcgacatcgccctggacgaggaggacctgagagccttccaggtgcagcaggccgtggacctgagaagacacaccgccagaaagagcagcatcaaggccgccgtgcccggcaacaccagcacccccagctgccagagcaccaacggccagccccagagaggcgcctgcggcagatggagaggcagaagcagaagcagaagagccgccaccagcagacccgagagagtgtggcccgacggcgtgatccccttcgtgatcggcggcaacttcaccggcagccagagagccgtgttcagacaggccatgagacactgggagaagcacacctgcgtgaccttcctggagagaaccgacgaggacagctacatcgtgttcacctacagaccctgcggctgctgcagctacgtgggcagaagaggcggcggcccccaggccatcagcatcggcaagaactgcgacaagttcggcatcgtggtgcacgagctgggccacgtggtgggcttctggcacgagcacaccagacccgacagagacagacacgtgagcatcgtgagagagaacatccagcccggccaggagtacaacttcctgaagatggagccccaggaggtggagagcctgggcgagacctacgacttcgacagcatcatgcactacgccagaaacaccttcagcagaggcatcttcctggacaccatcgtgcccaagtacgaggtgaacggcgtgaagccccccatcggccagagaaccagactgagcaagggcgacatcgcccaggccagaaagctgtacaagtgccccgcctgcggcgagaccctgcaggacagcaccggcaacttcagcagccccgagtaccccaacggctacagcgcccacatgcactgcgtgtggagaatcagcgtgacccccggcgagaagatcatcctgaacttcaccagcctggacctgtacagaagcagactgtgctggtacgactacgtggaggtgagagacggcttctggagaaaggcccccctgagaggcagattctgcggcagcaagctgcccgagcccatcgtgagcaccgacagcagactgtgggtggagttcagaagcagcagcaactgggtgggcaagggcttcttcgccgtgtacgaggccatctgcggcggcgacgtgaagaaggactacggccacatccagagccccaactaccccgacgactacagacccagcaaggtgtgcatctggagaatccaggtgagcgagggcttccacgtgggcctgaccttccagagcttcgagatcgagagacacgacagctgcgcctacgactacctggaggtgagagacggccacagcgagagcagcaccctgatcggcagatactgcggctacgagaagcccgacgacatcaagagcaccagcagcagactgtggctgaagttcgtgagcgacggcagcatcaacaaggccggcttcgccgtgaacttcttcaaggaggtggacgagtgcagcagacccaacagaggcggctgcgagcagagatgcctgaacaccctgggcagctacaagtgcagctgcgaccccggctacgagctggcccccgacaagagaagatgcgagggctgctacgacctgcaggtgggcaagcccctgctgtgggacagacactgcttcagactgagcacccacggccccgagatgctgggcaccgccctgagaggctag

SEQ ID NO: 9588 - DNA, 2472 bp, Artificial Sequence
  Description of Artificial Sequence: Synthetic coding sequence
atgcccggcgtggccagactgcccctgctgctgggcctgctgctgctgcccagacccggcagacccctggacctggccgactacacctacgacctggccgaggaggacgacagcgagcccctgaactacaaggacccctgcaaggccgccgccttcctgggcgacatcgccctggacgaggaggacctgagagccttccaggtgcagcaggccgtggacctgagaagacacaccgccagaaagagcagcatcaaggccgccgtgcccggcaacaccagcacccccagctgccagagcaccaacggccagccccagagaggcgcctgcggcagatggagaggcagaagcagaagcagaagagccgccaccagcagacccgagagagtgtggcccgacggcgtgatccccttcgtgatcggcggcaacttcaccggcagccagagagccgtgttcagacaggccatgagacactgggagaagcacacctgcgtgaccttcctggagagaaccgacgaggacagctacatcgtgttcacctacagaccctgcggctgctgcagctacgtgggcagaagaggcggcggcccccaggccatcagcatcggcaagaactgcgacaagttcggcatcgtggtgcacgagctgggccacgtggtgggcttctggcacgagcacaccagacccgacagagacagacacgtgagcatcgtgagagagaacatccagcccggccaggagtacaacttcctgaagatggagccccaggaggtggagagcctgggcgagacctacgacttcgacagcatcatgcactacgccagaaacaccttcagcagaggcatcttcctggacaccatcgtgcccaagtacgaggtgaacggcgtgaagccccccatcggccagagaaccagactgagcaagggcgacatcgcccaggccagaaagctgtacaagtgccccgcctgcggcgagaccctgcaggacagcaccggcaacttcagcagccccgagtaccccaacggctacagcgcccacatgcactgcgtgtggagaatcagcgtgacccccggcgagaagatcatcctgaacttcaccagcctggacctgtacagaagcagactgtgctggtacgactacgtggaggtgagagacggcttctggagaaaggcccccctgagaggcagattctgcggcagcaagctgcccgagcccatcgtgagcaccgacagcagactgtgggtggagttcagaagcagcagcaactgggtgggcaagggcttcttcgccgtgtacgaggccatctgcggcggcgacgtgaagaaggactacggccacatccagagccccaactaccccgacgactacagacccagcaaggtgtgcatctggagaatccaggtgagcgagggcttccacgtgggcctgaccttccagagcttcgagatcgagagacacgacagctgcgcctacgactacctggaggtgagagacggccacagcgagagcagcaccctgatcggcagatactgcggctacgagaagcccgacgacatcaagagcaccagcagcagactgtggctgaagttcgtgagcgacggcagcatcaacaaggccggcttcgccgtgaacttcttcaaggaggtggacgagtgcagcagacccaacagaggcggctgcgagcagagatgcctgaacaccctgggcagctacaagtgcagctgcgaccccggctacgagctggcccccgacaagagaagatgcgaggccgcctgcggcggcttcctgaccaagctgaacggcagcatcaccagccccggctggcccaaggagtacccccccaacaagaactgcatctggcagctggtggcccccacccagtacagaatcagcctgcagttcgacttcttcgagaccgagggcaacgacgtgtgcaagtacgacttcgtggaggtgagaagcggcctgaccgccgacagcaagctgcacggcaagttctgcggcagcgagaagcccgaggtgatcaccagccagtacaacaacatgagagtggagttcaagagcgacaacaccgtgagcaagaagggcttcaaggcccacttcttcagcgtgctggagggcgccggcgacagacacagccacctgagcggcctggagctgctgctgtgcccccacgccctggtggacaccgtgcccgccccccccagcgccctgcacggcgacacccacgcccacacccacacccacgtgcacacccactgccccatcgcccaggagacctgcagaggcccccccctgggcgccagcagactgagcccccagggccccggccacctgaccctggccccccaggagggcagctacctggacttctgggacacccacagaggcgaccccaagcccagaagaagaagaaagagcctgaagaccttcagcctgacccccgccaccttcagaggcatctgggccctgtag

SEQ ID NO: 9589 - DNA, 2193 bp, Artificial Sequence; identical to SEQ ID NO: 9584
  Description of Artificial Sequence: Synthetic coding sequence

SEQ ID NO: 9590 - DNA, 1509 bp, Artificial Sequence
  Description of Artificial Sequence: Synthetic coding sequence
atgctgctgagaagcgccggcaagctgaacgtgggcaccaagaaggaggacggcgagagcaccgcccccacccccagacccaaggtgctgagatgcaagtgccaccaccactgccccgaggacagcgtgaacaacatctgcagcaccgacggctactgcttcaccatgatcgaggaggacgacagcggcctgcccgtggtgaccagcggctgcctgggcctggagggcagcgacttccagtgcagagacacccccatcccccaccagagaagaagcatcgagtgctgcaccgagagaaacgagtgcaacaaggacctgcaccccaccctgccccccctgaagaacagagacttcgtggacggccccatccaccacagagccctgctgatcagcgtgaccgtgtgcagcctgctgctggtgctgatcatcctgttctgctacttcagatacaagagacaggagaccagacccagatacagcatcggcctggagcaggacgagacctacatcccccccggcgagagcctgagagacctgatcgagcagagccagagcagcggcagcggcagcggcctgcccctgctggtgcagagaaccatcgccaagcagatccagatggtgaagcagatcggcaagggcagatacggcgaggtgtggatgggcaagtggagaggcgagaaggtggccgtgaaggtgttcttcaccaccgaggaggccagctggttcagagagaccgagatctaccagaccgtgctgatgagacacgagaacatcctgggcttcatcgccgccgacatcaagggcaccggcagctggacccagctgtacctgatcaccgactaccacgagaacggcagcctgtacgactacctgaagagcaccaccctggacgccaagagcatgctgaagctggcctacagcagcgtgagcggcctgtgccacctgcacaccgagatcttcagcacccagggcaagcccgccatcgcccacagagacctgaagagcaagaacatcctggtgaagaagaacggcacctgctgcatcgccgacctgggcctggccgtgaagttcatcagcgacaccaacgaggtggacatcccccccaacaccagagtgggcaccaagagatacatgccccccgaggtgctggacgagagcctgaacagaaaccacttccagagctacatcatggccgacatgtacagcttcggcctgatcctgtgggaggtggccagaagatgcgtgagcggcggcatcgtggaggagtaccagctgccctaccacgacctggtgcccagcgaccccagctacgaggacatgagagagatcgtgtgcatcaagaagctgagacccagcttccccaacagatggagcagcgacgagtgcctgagacagatgggcaagctgatgaccgagtgctgggcccacaaccccgccagcagactgaccgccctgagagtgaagaagaccctggccaagatgagcgagagccaggacatcaagctgtag

SEQ ID NO: 9591 - DNA, 1509 bp, Artificial Sequence; identical to SEQ ID NO: 9590
  Description of Artificial Sequence: Synthetic coding sequence

SEQ ID NO: 9592 - DNA, 1599 bp, Artificial Sequence
  Description of Artificial Sequence: Synthetic coding sequence
atgggctggctggaggagctgaactggcagctgcacatcttcctgctgatcctgctgagcatgcacaccagagccaacttcctggacaacatgctgctgagaagcgccggcaagctgaacgtgggcaccaagaaggaggacggcgagagcaccgcccccacccccagacccaaggtgctgagatgcaagtgccaccaccactgccccgaggacagcgtgaacaacatctgcagcaccgacggctactgcttcaccatgatcgaggaggacgacagcggcctgcccgtggtgaccagcggctgcctgggcctggagggcagcgacttccagtgcagagacacccccatcccccaccagagaagaagcatcgagtgctgcaccgagagaaacgagtgcaacaaggacctgcaccccaccctgccccccctgaagaacagagacttcgtggacggccccatccaccacagagccctgctgatcagcgtgaccgtgtgcagcctgctgctggtgctgatcatcctgttctgctacttcagatacaagagacaggagaccagacccagatacagcatcggcctggagcaggacgagacctacatcccccccggcgagagcctgagagacctgatcgagcagagccagagcagcggcagcggcagcggcctgcccctgctggtgcagagaaccatcgccaagcagatccagatggtgaagcagatcggcaagggcagatacggcgaggtgtggatgggcaagtggagaggcgagaaggtggccgtgaaggtgttcttcaccaccgaggaggccagctggttcagagagaccgagatctaccagaccgtgctgatgagacacgagaacatcctgggcttcatcgccgccgacatcaagggcaccggcagctggacccagctgtacctgatcaccgactaccacgagaacggcagcctgtacgactacctgaagagcaccaccctggacgccaagagcatgctgaagctggcctacagcagcgtgagcggcctgtgccacctgcacaccgagatcttcagcacccagggcaagcccgccatcgcccacagagacctgaagagcaagaacatcctggtgaagaagaacggcacctgctgcatcgccgacctgggcctggccgtgaagttcatcagcgacaccaacgaggtggacatcccccccaacaccagagtgggcaccaagagatacatgccccccgaggtgctggacgagagcctgaacagaaaccacttccagagctacatcatggccgacatgtacagcttcggcctgatcctgtgggaggtggccagaagatgcgtgagcggcggcatcgtggaggagtaccagctgccctaccacgacctggtgcccagcgaccccagctacgaggacatgagagagatcgtgtgcatcaagaagctgagacccagcttccccaacagatggagcagcgacgagtgcctgagacagatgggcaagctgatgaccgagtgctgggcccacaaccccgccagcagactgaccgccctgagagtgaagaagaccctggccaagatgagcgagagccaggacatcaagctgtag

SEQ ID NO: 9593 - DNA, 345 bp, Artificial Sequence
  Description of Artificial Sequence: Synthetic coding sequence
atgctgctgagaagcgccggcaagctgaacgtgggcaccaagaaggaggacggcgagagcaccgcccccacccccagacccaaggtgctgagatgcaagtgccaccaccactgccccgaggacagcgtgaacaacatctgcagcaccgacggctactgcttcaccatgatcgaggaggacgacagcggcctgcccgtggtgaccagcggctgcctgggcctggagggcagcgacttccagtgcagagtgagaaccctgcccttcctgatcaaggaggaccagctgaacgccgcccagaagggcaccaacgtgatcaagacctacaccctgcactgcctgcactag

SEQ ID NO: 9594 - DNA, 378 bp, Artificial Sequence
  Description of Artificial Sequence: Synthetic coding sequence
atgctgctgagaagcgccggcaagctgaacgtgggcaccaagaaggaggacggcgagagcaccgcccccacccccagacccaaggtgctgagatgcaagtgccaccaccactgccccgaggacagcgtgaacaacatctgcagcaccgacggctactgcttcaccatgatcgaggaggacgacagcggcctgcccgtggtgaccagcggctgcctgggcctggagggcagcgacttccagtgcagagacacccccatcccccaccagagaagaagcatcgagtgctgcaccgagagaaacgagtgcaacaaggacctgcaccccaccctgccccccctgaagaacagagacttcgtggacggccccatccaccactag

SEQ ID NO: 9595 - DNA, 1509 bp, Artificial Sequence; identical to SEQ ID NO: 9590
  Description of Artificial Sequence: Synthetic coding sequence

SEQ ID NO: 9596 - DNA, 1509 bp, Artificial Sequence; identical to SEQ ID NO: 9590
  Description of Artificial Sequence: Synthetic coding sequence

SEQ ID NO: 9597 - DNA, 1509 bp, Artificial Sequence; identical to SEQ ID NO: 9590
  Description of Artificial Sequence: Synthetic coding sequence

SEQ ID NO: 9598 - DNA, 4755 bp, Artificial Sequence
  Description of Artificial Sequence: Synthetic coding sequence
atgagaggccaggccgccgcccccggccccgtgtggatcctggcccccctgctgctgctgctgctgctgctgggcagaagagccagagccgccgccggcgccgacgccggccccggccccgagccctgcgccaccctggtgcagggcaagttcttcggctacttcagcgccgccgccgtgttccccgccaacgccagcagatgcagctggaccctgagaaaccccgaccccagaagatacaccctgtacatgaaggtggccaaggcccccgtgccctgcagcggccccggcagagtgagaacctaccagttcgacagcttcctggagagcaccagaacctacctgggcgtggagagcttcgacgaggtgctgagactgtgcgaccccagcgcccccctggccttcctgcaggccagcaagcagttcctgcagatgagaagacagcagcccccccagcacgacggcctgagacccagagccggcccccccggccccaccgacgacttcagcgtggagtacctggtggtgggcaacagaaaccccagcagagccgcctgccagatgctgtgcagatggctggacgcctgcctggccggcagcagaagcagccacccctgcggcatcatgcagaccccctgcgcctgcctgggcggcgaggccggcggccccgccgccggccccctggcccccagaggcgacgtgtgcctgagagacgccgtggccggcggccccgagaactgcctgaccagcctgacccaggacagaggcggccacggcgccaccggcggctggaagctgtggagcctgtggggcgagtgcaccagagactgcggcggcggcctgcagaccagaaccagaacctgcctgcccgcccccggcgtggagggcggcggctgcgagggcgtgctggaggagggcagacagtgcaacagagaggcctgcggccccgccggcagaaccagcagcagaagccagagcctgagaagcaccgacgccagaagaagagaggagctgggcgacgagctgcagcagttcggcttccccgccccccagaccggcgaccccgccgccgaggagtggagcccctggagcgtgtgcagcagcacctgcggcgagggctggcagaccagaaccagattctgcgtgagcagcagctacagcacccagtgcagcggccccctgagagagcagagactgtgcaacaacagcgccgtgtgccccgtgcacggcgcctgggacgagtggagcccctggagcctgtgcagcagcacctgcggcagaggcttcagagacagaaccagaacctgcagacccccccagttcggcggcaacccctgcgagggccccgagaagcagaccaagttctgcaacatcgccctgtgccccggcagagccgtggacggcaactggaacgagtggagcagctggagcgcctgcagcgccagctgcagccagggcagacagcagagaaccagagagtgcaacggccccagctacggcggcgccgagtgccagggccactgggtggagaccagagactgcttcctgcagcagtgccccgtggacggcaagtggcaggcctgggccagctggggcagctgcagcgtgacctgcggcgccggcagccagagaagagagagagtgtgcagcggccccttcttcggcggcgccgcctgccagggcccccaggacgagtacagacagtgcggcacccagagatgccccgagccccacgagatctgcgacgaggacaacttcggcgccgtgatctggaaggagacccccgccggcgaggtggccgccgtgagatgccccagaaacgccaccggcctgatcctgagaagatgcgagctggacgaggagggcatcgcctactgggagccccccacctacatcagatgcgtgagcatcgactacagaaacatccagatgatgaccagagagcacctggccaaggcccagagaggcctgcccggcgagggcgtgagcgaggtgatccagaccctggtggagatcagccaggacggcaccagctacagcggcgacctgctgagcaccatcgacgtgctgagaaacatgaccgagatcttcagaagagcctactacagccccacccccggcgacgtgcagaacttcgtgcagatcctgagcaacctgctggccgaggagaacagagacaagtgggaggaggcccagctggccggccccaacgccaaggagctgttcagactggtggaggacttcgtggacgtgatcggcttcagaatgaaggacctgagagacgcctaccaggtgaccgacaacctggtgctgagcatccacaagctgcccgccagcggcgccaccgacatcagcttccccatgaagggctggagagccaccggcgactgggccaaggtgcccgaggacagagtgaccgtgagcaagagcgtgttcagcaccggcctgaccgaggccgacgaggccagcgtgttcgtggtgggcaccgtgctgtacagaaacctgggcagcttcctggccctgcagagaaacaccaccgtgctgaacagcaaggtgatcagcgtgaccgtgaagcccccccccagaagcctgagaacccccctggagatcgagttcgcccacatgtacaacggcaccaccaaccagacctgcatcctgtgggacgagaccgacgtgcccagcagcagcgcccccccccagctgggcccctggagctggagaggctgcagaaccgtgcccctggacgccctgagaaccagatgcctgtgcgacagactgagcaccttcgccatcctggcccagctgagcgccgacgccaacatggagaaggccaccctgcccagcgtgaccctgatcgtgggctgcggcgtgagcagcctgaccctgctgatgctggtgatcatctacgtgagcgtgtggagatacatcagaagcgagagaagcgtgatcctgatcaacttctgcctgagcatcatcagcagcaacgccctgatcctgatcggccagacccagaccagaaacaaggtggtgtgcaccctggtggccgccttcctgcacttcttcttcctgagcagcttctgctgggtgctgaccgaggcctggcagagctacatggccgtgaccggccacctgagaaacagactgatcagaaagagattcctgtgcctgggctggggcctgcccgccctggtggtggccatcagcgtgggcttcaccaaggccaagggctacagcaccatgaactactgctggctgagcctggagggcggcctgctgtacgccttcgtgggccccgccgccgccgtggtgctggtgaacatggtgatcggcatcctggtgttcaacaagctggtgagcaaggacggcatcaccgacaagaagctgaaggagagagccggcgccagcctgtggagcagctgcgtggtgctgcccctgctggccctgacctggatgagcgccgtgctggccgtgaccgacagaagaagcgccctgttccagatcctgttcgccgtgttcgacagcctggagggcttcgtgatcgtgatggtgcactgcatcctgagaagagaggtgcaggacgccgtgaagtgcagagtggtggacagacaggaggagggcaacggcgacagcggcggcagcttccagaacggccacgcccagctgatgaccgacttcgagaaggacgtggacctggcctgcagaagcgtgctgaacaaggacatcgccgcctgcagaaccgccaccatcaccggcaccctgaagagacccagcctgcccgaggaggagaagctgaagctggcccacgccaagggcccccccaccaacttcaacagcctgcccgccaacgtgagcaagctgcacctgcacggcagccccagataccccggcggccccctgcccgacttccccaaccacagcctgaccctgaagagagacaaggcccccaagagcagcttcgtgggcgacggcgacatcttcaagaagctggacagcgagctgagcagagcccaggagaaggccctggacaccagctacgtgatcctgcccaccgccaccgccaccctgagacccaagcccaaggaggagcccaagtacagcatccacatcgaccagatgccccagaccagactgatccacctgagcaccgcccccgaggccagcctgcccgccagaagcccccccagcagacagccccccagcggcggcccccccgaggccccccccgcccagcccccccccccccccccccccccccccccccccccccagcagcccctgccccccccccccaacctggagcccgccccccccagcctgggcgaccccggcgagcccgccgcccaccccggccccagcaccggccccagcaccaagaacgagaacgtggccaccctgagcgtgagcagcctggagagaagaaagagcagatacgccgagctggacttcgagaagatcatgcacaccagaaagagacaccaggacatgttccaggacctgaacagaaagctgcagcacgccgccgagaaggacaaggaggtgctgggccccgacagcaagcccgagaagcagcagacccccaacaagagaccctgggagagcctgagaaaggcccacggcacccccacctgggtgaagaaggagctggagcccctgcagcccagccccctggagctgagaagcgtggagtgggagagaagcggcgccaccatccccctggtgggccaggacatcatcgacctgcagaccgaggtgtag

SEQ ID NO: 9599 - DNA, 4755 bp, Artificial Sequence; identical to SEQ ID NO: 9598
  Description of Artificial Sequence: Synthetic coding sequence

SEQ ID NO: 9600 - DNA, 2334 bp, Artificial Sequence
  Description of Artificial Sequence: Synthetic coding sequence
atgcccgacaacagacagcccagaaacagacagcccagaatcagaagcggcaacgagcccagaagcgcccccgccatggagcccgacggcagaggcgcctgggcccacagcagagccgccctggacagactggagaagctgctgagatgcagcagatgcaccaacatcctgagagagcccgtgtgcctgggcggctgcgagcacatcttctgcagcaactgcgtgagcgactgcatcggcaccggctgccccgtgtgctacacccccgcctggatccaggacctgaagatcaacagacagctggacagcatgatccagctgtgcagcaagctgagaaacctgctgcacgacaacgagctgagcgacctgaaggaggacaagcccagaaagagcctgttcaacgacgccggcaacaagaagaacagcatcaagatgtggttcagccccagaagcaagaaggtgagatacgtggtgagcaaggccagcgtgcagacccagcccgccatcaagaaggacgccagcgcccagcaggacagctacgagttcgtgagccccagcccccccgccgacgtgagcgagagagccaagaaggccagcgccagaagcggcaagaagcagaagaagaagaccctggccgagatcaaccagaagtggaacctggaggccgagaaggaggacggcgagttcgacagcaaggaggagagcaagcagaagctggtgagcttctgcagccagcccagcgtgatcagcagcccccagatcaacggcgagatcgacctgctggccagcggcagcctgaccgagagcgagtgcttcggcagcctgaccgaggtgagcctgcccctggccgagcagatcgagagccccgacaccaagagcagaaacgaggtggtgacccccgagaaggtgtgcaagaactacctgaccagcaagaagagcctgcccctggagaacaacggcaagagaggccaccacaacagactgagcagccccatcagcaagagatgcagaaccagcatcctgagcaccagcggcgacttcgtgaagcagaccgtgcccagcgagaacatccccctgcccgagtgcagcagcccccccagctgcaagagaaaggtgggcggcaccagcggcagaaagaacagcaacatgagcgacgagttcatcagcctgagccccggcaccccccccagcaccctgagcagcagcagctacagaagagtgatgagcagccccagcgccatgaagctgctgcccaacatggccgtgaagagaaaccacagaggcgagaccctgctgcacatcgccagcatcaagggcgacatccccagcgtggagtacctgctgcagaacggcagcgaccccaacgtgaaggaccacgccggctggacccccctgcacgaggcctgcaaccacggccacctgaaggtggtggagctgctgctgcagcacaaggccctggtgaacaccaccggctaccagaacgacagccccctgcacgacgccgccaagaacggccacgtggacatcgtgaagctgctgctgagctacggcgccagcagaaacgccgtgaacatcttcggcctgagacccgtggactacaccgacgacgagagcatgaagagcctgctgctgctgcccgagaagaacgagagcagcagcgccagccactgcagcgtgatgaacaccggccagagaagagacggccccctggtgctgatcggcagcggcctgagcagcgagcagcagaagatgctgagcgagctggccgtgatcctgaaggccaagaagtacaccgagttcgacagcaccgtgacccacgtggtggtgcccggcgacgccgtgcagagcaccctgaagtgcatgctgggcatcctgaacggctgctggatcctgaagttcgagtgggtgaaggcctgcctgagaagaaaggtgtgcgagcaggaggagaagtacgagatccccgagggccccagaagaagcagactgaacagagagcagctgctgcccaagctgttcgacggctgctacttctacctgtggggcaccttcaagcaccaccccaaggacaacctgatcaagctggtgaccgccggcggcggccagatcctgagcagaaagcccaagcccgacagcgacgtgacccagaccatcaacaccgtggcctaccacgccagacccgacagcgaccagagattctgcacccagtacatcatctacgaggacctgtgcaactaccaccccgagagagtgagacagggcaaggtgtggaaggcccccagcagctggttcatcgactgcgtgatgagcttcgagctgctgcccctggacagctag

SEQ ID NO: 9601 - DNA, 1704 bp, Artificial Sequence
  Description of Artificial Sequence: Synthetic coding sequence
atgtggttcagccccagaagcaagaaggtgagatacgtggtgagcaaggccagcgtgcagacccagcccgccatcaagaaggacgccagcgcccagcaggacagctacgagttcgtgagccccagcccccccgccgacgtgagcgagagagccaagaaggccagcgccagaagcggcaagaagcagaagaagaagaccctggccgagatcaaccagaagtggaacctggaggccgagaaggaggacggcgagttcgacagcaaggaggagagcaagcagaagctggtgagcttctgcagccagcccagcgtgatcagcagcccccagatcaacggcgagatcgacctgctggccagcggcagcctgaccgagagcgagtgcttcggcagcctgaccgaggtgagcctgcccctggccgagcagatcgagagccccgacaccaagagcagaaacgaggtggtgacccccgagaaggtgtgcaagaactacctgaccagcaagaagagcctgcccctggagaacaacggcaagagaggccaccacaacagactgagcagccccatcagcaagagatgcagaaccagcatcctgagcaccagcggcgacttcgtgaagcagaccgtgcccagcgagaacatccccctgcccgagtgcagcagcccccccagctgcaagagaaaggtgggcggcaccagcggcagaaagaacagcaacatgagcgacgagttcatcagcctgagccccggcaccccccccagcaccctgagcagcagcagctacagaagagtgatgagcagccccagcgccatgaagctgctgcccaacatggccgtgaagagaaaccacagaggcgagaccctgctgcacatcgccagcatcaagggcgacatccccagcgtggagtacctgctgcagaacggcagcgaccccaacgtgaaggaccacgccggctggacccccctgcacgaggcctgcaaccacggccacctgaaggtggtggagctgctgctgcagcacaaggccctggtgaacaccaccggctaccagaacgacagccccctgcacgacgccgccaagaacggccacgtggacatcgtgaagctgctgctgagctacggcgccagcagaaacgccgtgaacatcttcggcctgagacccgtggactacaccgacgacgagagcatgaagagcctgctgctgctgcccgagaagaacgagagcagcagcgccagccactgcagcgtgatgaacaccggccagagaagagacggccccctggtgctgatcggcagcggcctgagcagcgagcagcagaagatgctgagcgagctggccgtgatcctgaaggccaagaagtacaccgagttcgacagcaccgtgacccacgtggtggtgcccggcgacgccgtgcagagcaccctgaagtgcatgctgggcatcctgaacggctgctggatcctgaagttcgagtgggtgaaggcctgcctgagaagaaaggtgtgcgagcaggaggagaagtacgagatccccgagggccccagaagaagcagactgaacagagagcactgccagagctgcctgatggacgccaccagcatctgcggcgagcccagcaacaccatccagagaaccaccctgctgagcagcagcctgcaggtgggcgccagaagcagcgtggagagccccagccagaccgtgacctag

SEQ ID NO: 9602 - DNA, 3750 bp, Artificial Sequence
  Description of Artificial Sequence: Synthetic coding sequence
atgagcagcatgtggagcgagtacaccatcggcggcgtgaagatctacttcccctacaaggcctaccccagccagctggccatgatgaacagcatcctgagaggcctgaacagcaagcagcactgcctgctggagagccccaccggcagcggcaagagcctggccctgctgtgcagcgccctggcctggcagcagagcctgagcggcaagcccgccgacgagggcgtgagcgagaaggccgaggtgcagctgagctgctgctgcgcctgccacagcaaggacttcaccaacaacgacatgaaccagggcaccagcagacacttcaactaccccagcaccccccccagcgagagaaacggcaccagcagcacctgccaggacagccccgagaagaccaccctggccgccaagctgagcgccaagaagcaggccagcatctacagagacgagaacgacgacttccaggtggagaagaagagaatcagacccctggagaccacccagcagatcagaaagagacactgcttcggcaccgaggtgcacaacctggacgccaaggtggacagcggcaagaccgtgaagctgaacagccccctggagaagatcaacagcttcagcccccagaagccccccggccactgcagcagatgctgctgcagcaccaagcagggcaacagccaggagagcagcaacaccatcaagaaggaccacaccggcaagagcaagatccccaagatctacttcggcaccagaacccacaagcagatcgcccagatcaccagagagctgagaagaaccgcctacagcggcgtgcccatgaccatcctgagcagcagagaccacacctgcgtgcaccccgaggtggtgggcaacttcaacagaaacgagaagtgcatggagctgctggacggcaagaacggcaagagctgctacttctaccacggcgtgcacaagatcagcgaccagcacaccctgcagaccttccagggcatgtgcaaggcctgggacatcgaggagctggtgagcctgggcaagaagctgaaggcctgcccctactacaccgccagagagctgatccaggacgccgacatcatcttctgcccctacaactacctgctggacgcccagatcagagagagcatggacctgaacctgaaggagcaggtggtgatcctggacgaggcccacaacatcgaggactgcgccagagagagcgccagctacagcgtgaccgaggtgcagctgagattcgccagagacgagctggacagcatggtgaacaacaacatcagaaagaaggaccacgagcccctgagagccgtgtgctgcagcctgatcaactggctggaggccaacgccgagtacctggtggagagagactacgagagcgcctgcaagatctggagcggcaacgagatgctgctgaccctgcacaagatgggcatcaccaccgccaccttccccatcctgcagggccacttcagcgccgtgctgcagaaggaggagaagatcagccccatctacggcaaggaggaggccagagaggtgcccgtgatcagcgccagcacccagatcatgctgaagggcctgttcatggtgctggactacctgttcagacagaacagcagattcgccgacgactacaagatcgccatccagcagacctacagctggaccaaccagatcgacatcagcgacaagaacggcctgctggtgctgcccaagaacaagaagagaagcagacagaagaccgccgtgcacgtgctgaacttctggtgcctgaaccccgccgtggccttcagcgacatcaacggcaaggtgcagaccatcgtgctgaccagcggcaccctgagccccatgaagagcttcagcagcgagctgggcgtgaccttcaccatccagctggaggccaaccacatcatcaagaacagccaggtgtgggtgggcaccatcggcagcggccccaagggcagaaacctgtgcgccaccttccagaacaccgagaccttcgagttccaggacgaggtgggcgccctgctgctgagcgtgtgccagaccgtgagccagggcatcctgtgcttcctgcccagctacaagctgctggagaagctgaaggagagatggctgagcaccggcctgtggcacaacctggagctggtgaagaccgtgatcgtggagccccagggcggcgagaagaccaacttcgacgagctgctgcaggtgtactacgacgccatcaagtacaagggcgagaaggacggcgccctgctggtggccgtgtgcagaggcaaggtgagcgagggcctggacttcagcgacgacaacgccagagccgtgatcaccatcggcatccccttccccaacgtgaaggacctgcaggtggagctgaagagacagtacaacgaccaccacagcaagctgagaggcctgctgcccggcagacagtggtacgagatccaggcctacagagccctgaaccaggccctgggcagatgcatcagacacagaaacgactggggcgccctgatcctggtggacgacagattcagaaacaaccccagcagatacatcagcggcctgagcaagtgggtgagacagcagatccagcaccacagcaccttcgagagcgccctggagagcctggccgagttcagcaagaagcaccagaaggtgctgaacgtgagcatcaaggacagaaccaacatccaggacaacgagagcaccctggaggtgaccagcctgaagtacagcaccagcccctacctgctggaggccgccagccacctgagccccgagaacttcgtggaggacgaggccaagatctgcgtgcaggagctgcagtgccccaagatcatcaccaagaacagccccctgcccagcagcatcatcagcagaaaggagaagaacgaccccgtgttcctggaggaggccggcaaggccgagaagatcgtgatcagcagaagcaccagccccaccttcaacaagcagaccaagagagtgagctggagcagcttcaacagcctgggccagtacttcaccggcaagatccccaaggccacccccgagctgggcagcagcgagaacagcgccagcagcccccccagattcaagaccgagaagatggagagcaagaccgtgctgcccttcaccgacaagtgcgagagcagcaacctgaccgtgaacaccagcttcggcagctgcccccagagcgagaccatcatcagcagcctgaagatcgacgccaccctgaccagaaagaaccacagcgagcaccccctgtgcagcgaggaggccctggaccccgacatcgagctgagcctggtgagcgaggaggacaagcagagcaccagcaacagagacttcgagaccgaggccgaggacgagagcatctacttcacccccgagctgtacgaccccgaggacaccgacgaggagaagaacgacctggccgagaccgacagaggcaacagactggccaacaacagcgactgcatcctggccaaggacctgttcgagatcagaaccatcaaggaggtggacagcgccagagaggtgaaggccgaggactgcatcgacaccaagctgaacggcatcctgcacatcgaggagagcaagatcgacgacatcgacggcaacgtgaagaccacctggatcaacgagctggagctgggcaagacccacgagatcgagatcaagaacttcaagcccagccccagcaagaacaagggcatgttccccggcttcaagtag

SEQ ID NO: 9603 - DNA, 945 bp, Artificial Sequence
  Description of Artificial Sequence: Synthetic coding sequence
atggccagcagaagcaagagaagagccgtggagagcggcgtgccccagccccccgacccccccgtgcagagagacgaggaggaggagaaggaggtggagaacgaggacgaggacgacgacgacagcgacaaggagaaggacgaggaggacgaggtgatcgacgaggaggtgaacatcgagttcgaggcctacagcctgagcgacaacgactacgacggcatcaagaagctgctgcagcagctgttcctgaaggcccccgtgaacaccgccgagctgaccgacctgctgatccagcagaaccacatcggcagcgtgatcaagcagaccgacgtgagcgaggacagcaacgacgacatggacgaggacgaggtgttcggcttcatcagcctgctgaacctgaccgagagaaagggcacccagtgcgtggagcagatccaggagctggtgctgagattctgcgagaagaactgcgagaagagcatggtggagcagctggacaagttcctgaacgacaccaccaagcccgtgggcctgctgctgagcgagagattcatcaacgtgcccccccagatcgccctgcccatgtaccagcagctgcagaaggagctggccggcgcccacagaaccaacaagccctgcggcaagtgctacttctacctgctgatcagcaagaccttcgtggaggccggcaagaacaacagcaagaagaagcccagcaacaagaagaaggccgccctgatgttcgccaacgccgaggaggagttcttctacgagaaggccatcctgaagttcaactacagcgtgcaggaggagagcgacacctgcctgggcggcaagtggagcttcgacgacgtgcccatgacccccctgagaaccgtgatgctgatccccggcgacaagatgaacgagatcatggacaagctgaaggagtacctgagcgtgtag

SEQ ID NO: 9604 - DNA, 879 bp, Artificial Sequence
  Description of Artificial Sequence: Synthetic coding sequence
atggccagcagaagcaagagaagagccgtggagagcggcgtgccccagccccccgacccccccgtgcagagagacgaggaggaggagaaggaggtggagaacgaggacgaggacgacgacgacagcgacaaggagaaggacgaggaggacgaggtgatcgacgaggaggtgaacatcgagttcgaggcctacagcctgagcgacaacgactacgacggcatcaagaagctgctgcagcagctgttcctgaaggcccccgtgaacaccgccgagctgaccgacctgctgatccagcagaaccacatcggcagcgtgatcaagcagaccgacgtgagcgaggacagcaacgacgacatggacgaggacgaggtgttcggcttcatcagcctgctgaacctgaccgagagaaagggcacccagtgcgtggagcagatccaggagctggtgctgagattctgcgagaagaactgcgagaagagcatggtggagcagctggacaagttcctgaacgacaccaccaagcccgtgggcctgctgctgagcgagagattcatcaacgtgcccccccagatcgccctgcccatgtaccagcagctgcagaaggagctggccggcgcccacagaaccaacaagccctgcggcaagtgctacttctacctgctgatcagcaagaccttcgtggaggccggcaagaacaacagcaagaagaagcccagcaacaagaagaaggccgccctgatgttcgccaacgccgaggaggagttcttctacgaggagcagggcaagcccgaggtgctgggcggccccgacaccagaagaggcctggagcccgtgcccatccagcacaacggctggagcgtgccccccgtgctggagtag

SEQ ID NO: 9605 - DNA, 969 bp, Artificial Sequence
  Description of Artificial Sequence: Synthetic coding sequence
atggccagcagaagcaagagaagagccgtggagagcggcgtgccccagccccccgacccccccgtgcagagagacgaggaggaggagaaggaggtggagaacgaggacgaggacgacgacgacagcgacaaggagaaggacgaggaggacgaggtgatcgacgaggaggtgaacatcgagttcgaggcctacagcctgagcgacaacgactacgacggcatcaagaagctgctgcagcagctgttcctgaaggcccccgtgaacaccgccgagctgaccgacctgctgatccagcagaaccacatcggcagcgtgatcaagcagaccgacgtgagcgaggacagcaacgacgacatggacgaggacgaggtgttcggcttcatcagcctgctgaacctgaccgagagaaagggcacccagtgcgtggagcagatccaggagctggtgctgagattctgcgagaagaactgcgagaagagcatggtggagcagctggacaagttcctgaacgacaccaccaagcccgtgggcctgctgctgagcgagagattcatcaacgtgcccccccagatcgccctgcccatgtaccagcagctgcagaaggagctggccggcgcccacagaaccaacaagccctgcggcaagtgctacttctacctgctgatcagcaagaccttcgtggaggccggcaagaacaacagcaagaagaagcccagcaacaagaagaaggccgccctgatgttcgccaacgccgaggaggagttcttctacgaggagcagggcaagcccgaggtgctgggcggccccgacaccagaagaggcctggagcccgtgcccatccagcacaacggcggcagcagaggccaggtgaccgccctggtgagcctgaaggccggcctgatccagagcagaagcaccctgagcgacttccagggcaccttcatgaccgtgggcatcgccctgagctag

SEQ ID NO: 9606 - DNA, 879 bp, Artificial Sequence
  Description of Artificial Sequence: Synthetic coding sequence
atggccagcagaagcaagagaagagccgtggagagcggcgtgccccagccccccgacccccccgtgcagagagacgaggaggaggagaaggaggtggagaacgaggacgaggacgacgacgacagcgacaaggagaaggacgaggaggacgaggtgatcgacgaggaggtgaacatcgagttcgaggcctacagcctgagcgacaacgactacgacggcatcaagaagctgctgcagcagctgttcctgaaggcccccgtgaacaccgccgagctgaccgacctgctgatccagcagaaccacatcggcagcgtgatcaagcagaccgacgtgagcgaggacagcaacgacgacatggacgaggacgaggtgttcggcttcatcagcctgctgaacctgaccgagagaaagggcacccagtgcgtggagcagatccaggagctggtgctgagattctgcgagaagaactgcgagaagagcatggtggagcagctggacaagttcctgaacgacaccaccaagcccgtgggcctgctgctgagcgagagattcatcaacgtgcccccccagatcgccctgcccatgtaccagcagctgcagaaggagctggccggcgcccacagaaccaacaagccctgcggcaagtgctacttctacctgctgatcagcaagaccttcgtggaggccggcaagaacaacagcaagaagaagcccagcaacaagaagaaggccgccctgatgttcgccaacgccgaggaggagttcttctacgagaaggccatcctgaagttcaactacagcgtgcaggaggagagcgacacctgcctgggcggcaagtggagcttcgacgactggagcgtgccccccgtgctggagtag

SEQ ID NO: 9607 - DNA, 789 bp, Artificial Sequence
  Description of Artificial Sequence: Synthetic coding sequence
atggccagcagaagcaagagaagagccgtggagagcggcgtgccccagccccccgacccccccgtgcagagagacgaggaggaggagaaggaggtggagaacgaggacgaggacgacgacgacagcgacaaggagaaggacgaggaggacgaggtgatcgacgaggaggtgaacatcgagttcgaggcctacagcctgagcgacaacgactacgacggcatcaagaagctgctgcagcagctgttcctgaaggcccccgtgaacaccgccgagctgaccgacctgctgatccagcagaaccacatcggcagcgtgatcaagggcacccagtgcgtggagcagatccaggagctggtgctgagattctgcgagaagaactgcgagaagagcatggtggagcagctggacaagttcctgaacgacaccaccaagcccgtgggcctgctgctgagcgagagattcatcaacgtgcccccccagatcgccctgcccatgtaccagcagctgcagaaggagctggccggcgcccacagaaccaacaagccctgcggcaagtgctacttctacctgctgatcagcaagaccttcgtggaggccggcaagaacaacagcaagaagaagcccagcaacaagaagaaggccgccctgatgttcgccaacgccgaggaggagttcttctacgaggagcagggcaagcccgaggtgctgggcggccccgacaccagaagaggcctggagcccgtgcccatccagcacaacggctggagcgtgccccccgtgctggagtag

SEQ ID NO: 9608 - DNA, 1398 bp, Artificial Sequence
  Description of Artificial Sequence: Synthetic coding sequence
atggtggaccccgtgggcttcgccgaggcctggaaggcccagttccccgacagcgagccccccagaatggagctgagaagcgtgggcgacatcgagcaggagctggagagatgcaaggccagcatcagaagactggagcaggaggtgaaccaggagagattcagaatgatctacctgcagaccctgctggccaaggagaagaagagctacgacagacagagatggggcttcagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcgtggccgccctgagaagcaacttcgagagaatcagaaagggccacggccagcccggcgccgacgccgagaagcccttctacgtgaacgtggagttccaccacgagagaggcctggtgaaggtgaacgacaaggaggtgagcgacagaatcagcagcctgggcagccaggccatgcagatggagagaaagaagagccagcacggcgccggcagcagcgtgggcgacgccagcagacccccctacagaggcagaagcagcgagagcagctgcggcgtggacggcgactacgaggacgccgagctgaaccccagattcctgaaggacaacctgatcgacgccaacggcggcagcagacccccctggccccccctggagtaccagccctaccagagcatctacgtgggcggcatgatggagggcgagggcaagggccccctgctgagaagccagagcaccagcgagcaggagaagagactgacctggcccagaagaagctacagccccagaagcttcgaggactgcggcggcggctacacccccgactgcagcagcaacgagaacctgaccagcagcgaggaggacttcagcagcggccagagcagcagagtgagccccagccccaccacctacagaatgttcagagacaagagcagaagccccagccagaacagccagcagagcttcgacagcagcagcccccccaccccccagtgccacaagagacacagacactgccccgtggtggtgagcgaggccaccatcgtgggcgtgagaaagaccggccagatctggcccaacgacggcgagggcgccttccacggcgagcaccccggcgccgccgaggaggtgttccagaagctgctgcccgacatcagaggcgccgccgacgccgaccagctggtgtgcgagacccccgactgcccccagcacagcgccgaccaccagtag

SEQ ID NO: 9609 - DNA, 1377 bp, Artificial Sequence
  Description of Artificial Sequence: Synthetic coding sequence
atggtggaccccgtgggcttcgccgaggcctggaaggcccagttccccgacagcgagccccccagaatggagctgagaagcgtgggcgacatcgagcaggagctggagagatgcaaggccagcatcagaagactggagcaggaggtgaaccaggagagattcagaatgatctacctgcagaccctgctggccaaggagaagaagagctacgacagacagagatggggcttcagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcgtggccgccctgagaagcaacttcgagagaatcagaaagggccacggccagcccggcgccgacgccgagaagcccttctacgtgaacgtggagttccaccacgagagaggcctggtgaaggtgaacgacaaggaggtgagcgacagaatcagcagcctgggcagccaggccatgcagatggagagaaagaagagccagcacggcgccggcagcagcgtgggcgacgccagcagacccccctacagaggcagaagcagcgagagcagctgcggcgtggacggcgactacgaggacgccgagctgaaccccagattcctgaaggacaacctgatcgacgccaacggcggcagcagacccccctggccccccctggagtaccagccctaccagagcatctacgtgggcggcatgatggagggcgagggcaagggccccctgctgagaagccagagcaccagcgagcaggagaagagactgacctggcccagaagaagctacagccccagaagcttcgaggactgcggcggcggctacacccccgactgcagcagcaacgagaacctgaccagcagcgaggaggacttcagcagcggccagagcagcagagtgagccccagccccaccacctacagaatgttcagagacaagagcagaagccccagccagaacagccagcagagcttcgacagcagcagcccccccaccccccagtgccacaagagacacagacactgccccgtggtggtgagcgaggccaccatcgtgggcgtgagaaagaccggccagatctggcccaacgacggcgagggcgccttccacggcgacgccgacggcagcttcggcaccccccccggctacggctgcctgtgcctgcccgcctggcccagcggctgcaccgccgccaccgccagagtgaccagaagctag

SEQ ID NO: 9610 - DNA, 3816 bp, Artificial Sequence
  Description of Artificial Sequence: Synthetic coding sequence
atggtggaccccgtgggcttcgccgaggcctggaaggcccagttccccgacagcgagccccccagaatggagctgagaagcgtgggcgacatcgagcaggagctggagagatgcaaggccagcatcagaagactggagcaggaggtgaaccaggagagattcagaatgatctacctgcagaccctgctggccaaggagaagaagagctacgacagacagagatggggcttcagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcgtggccgccctgagaagcaacttcgagagaatcagaaagggccacggccagcccggcgccgacgccgagaagcccttctacgtgaacgtggagttccaccacgagagaggcctggtgaaggtgaacgacaaggaggtgagcgacagaatcagcagcctgggcagccaggccatgcagatggagagaaagaagagccagcacggcgccggcagcagcgtgggcgacgccagcagacccccctacagaggcagaagcagcgagagcagctgcggcgtggacggcgactacgaggacgccgagctgaaccccagattcctgaaggacaacctgatcgacgccaacggcggcagcagacccccctggccccccctggagtaccagccctaccagagcatctacgtgggcggcatgatggagggcgagggcaagggccccctgctgagaagccagagcaccagcgagcaggagaagagactgacctggcccagaagaagctacagccccagaagcttcgaggactgcggcggcggctacacccccgactgcagcagcaacgagaacctgaccagcagcgaggaggacttcagcagcggccagagcagcagagtgagccccagccccaccacctacagaatgttcagagacaagagcagaagccccagccagaacagccagcagagcttcgacagcagcagcccccccaccccccagtgccacaagagacacagacactgccccgtggtggtgagcgaggccaccatcgtgggcgtgagaaagaccggccagatctggcccaacgacggcgagggcgccttccacggcgacgccgacggcagcttcggcaccccccccggctacggctgcgccgccgacagagccgaggagcagagaagacaccaggacggcctgccctacatcgacgacagccccagcagcagcccccacctgagcagcaagggcagaggcagcagagacgccctggtgagcggcgccctggagagcaccaaggccagcgagctggacctggagaagggcctggagatgagaaagtgggtgctgagcggcatcctggccagcgaggagacctacctgagccacctggaggccctgctgctgcccatgaagcccctgaaggccgccgccaccaccagccagcccgtgctgaccagccagcagatcgagaccatcttcttcaaggtgcccgagctgtacgagatccacaaggagttctacgacggcctgttccccagagtgcagcagtggagccaccagcagagagtgggcgacctgttccagaagctggccagccagctgggcgtgtacagagccttcgtggacaactacggcgtggccatggagatggccgagaagtgctgccaggccaacgcccagttcgccgagatcagcgagaacctgagagccagaagcaacaaggacgccaaggaccccaccaccaagaacagcctggagaccctgctgtacaagcccgtggacagagtgaccagaagcaccctggtgctgcacgacctgctgaagcacacccccgccagccaccccgaccaccccctgctgcaggacgccctgagaatcagccagaacttcctgagcagcatcaacgaggagatcacccccagaagacagagcatgaccgtgaagaagggcgagcacagacagctgctgaaggacagcttcatggtggagctggtggagggcgccagaaagctgagacacgtgttcctgttcaccgacctgctgctgtgcaccaagctgaagaagcagagcggcggcaagacccagcagtacgactgcaagtggtacatccccctgaccgacctgagcttccagatggtggacgagctggaggccgtgcccaacatccccctggtgcccgacgaggagctggacgccctgaagatcaagatcagccagatcaagaacgacatccagagagagaagagagccaacaagggcagcaaggccaccgagagactgaagaagaagctgagcgagcaggagagcctgctgctgctgatgagccccagcatggccttcagagtgcacagcagaaacggcaagagctacaccttcctgatcagcagcgactacgagagagccgagtggagagagaacatcagagagcagcagaagaagtgcttcagaagcttcagcctgaccagcgtggagctgcagatgctgaccaacagctgcgtgaagctgcagaccgtgcacagcatccccctgaccatcaacaaggaggacgacgagagccccggcctgtacggcttcctgaacgtgatcgtgcacagcgccaccggcttcaagcagagcagcaacctgtactgcaccctggaggtggacagcttcggctacttcgtgaacaaggccaagaccagagtgtacagagacaccgccgagcccaactggaacgaggagttcgagatcgagctggagggcagccagaccctgagaatcctgtgctacgagaagtgctacaacaagaccaagatccccaaggaggacggcgagagcaccgacagactgatgggcaagggccaggtgcagctggacccccaggccctgcaggacagagactggcagagaaccgtgatcgccatgaacggcatcgaggtgaagctgagcgtgaagttcaacagcagagagttcagcctgaagagaatgcccagcagaaagcagaccggcgtgttcggcgtgaagatcgccgtggtgaccaagagagagagaagcaaggtgccctacatcgtgagacagtgcgtggaggagatcgagagaagaggcatggaggaggtgggcatctacagagtgagcggcgtggccaccgacatccaggccctgaaggccgccttcgacgtgaacaacaaggacgtgagcgtgatgatgagcgagatggacgtgaacgccatcgccggcaccctgaagctgtacttcagagagctgcccgagcccctgttcaccgacgagttctaccccaacttcgccgagggcatcgccctgagcgaccccgtggccaaggagagctgcatgctgaacctgctgctgagcctgcccgaggccaacctgctgaccttcctgttcctgctggaccacctgaagagagtggccgagaaggaggccgtgaacaagatgagcctgcacaacctggccaccgtgttcggccccaccctgctgagacccagcgagaaggagagcaagctgcccgccaaccccagccagcccatcaccatgaccgacagctggagcctggaggtgatgagccaggtgcaggtgctgctgtacttcctgcagctggaggccatccccgcccccgacagcaagagacagagcatcctgttcagcaccgaggtgtag

SEQ ID NO: 9611 - DNA, 2811 bp, Artificial Sequence
  Description of Artificial Sequence: Synthetic coding sequence
cccagcgcccccagagtgagcaccgtgggcctgctgtgcagcggcgccggcccccacctgtgcccctgcgccgaggagggcaccggcggcctggagagccagggcgagatcatccccagcagaggcagcagaaagcccgacggcgtgagcggcagcagaagactgttcagcagcctgtgcaagagccaggagggcagcagaaaggagtgcctgagaaagcacagaagactgggccccgccatgcccgtgagcagccccggcttccccggccccctggccagaagcgagcaccacctggacaccgccgccctgcagaccggccagagaagcagcgccggcaccaagatgggctgccccaccctgatgaccagacccccccacagacccaccagcgccgccagagccggcgccgccggcatgagatggagcagagagccctggagccccctgaagagaagcgagctggacctggagaagggcctggagatgagaaagtgggtgctgagcggcatcctggccagcgaggagacctacctgagccacctggaggccctgctgctgcccatgaagcccctgaaggccgccgccaccaccagccagcccgtgctgaccagccagcagatcgagaccatcttcttcaaggtgcccgagctgtacgagatccacaaggagttctacgacggcctgttccccagagtgcagcagtggagccaccagcagagagtgggcgacctgttccagaagctggccagccagctgggcgtgtacagagccttcgtggacaactacggcgtggccatggagatggccgagaagtgctgccaggccaacgcccagttcgccgagatcagcgagaacctgagagccagaagcaacaaggacgccaaggaccccaccaccaagaacagcctggagaccctgctgtacaagcccgtggacagagtgaccagaagcaccctggtgctgcacgacctgctgaagcacacccccgccagccaccccgaccaccccctgctgcaggacgccctgagaatcagccagaacttcctgagcagcatcaacgaggagatcacccccagaagacagagcatgaccgtgaagaagggcgagcacagacagctgctgaaggacagcttcatggtggagctggtggagggcgccagaaagctgagacacgtgttcctgttcaccgacctgctgctgtgcaccaagctgaagaagcagagcggcggcaagacccagcagtacgactgcaagtggtacatccccctgaccgacctgagcttccagatggtggacgagctggaggccgtgcccaacatccccctggtgcccgacgaggagctggacgccctgaagatcaagatcagccagatcaagaacgacatccagagagagaagagagccaacaagggcagcaaggccaccgagagactgaagaagaagctgagcgagcaggagagcctgctgctgctgatgagccccagcatggccttcagagtgcacagcagaaacggcaagagctacaccttcctgatcagcagcgactacgagagagccgagtggagagagaacatcagagagcagcagaagaagtgcttcagaagcttcagcctgaccagcgtggagctgcagatgctgaccaacagctgcgtgaagctgcagaccgtgcacagcatccccctgaccatcaacaaggaggacgacgagagccccggcctgtacggcttcctgaacgtgatcgtgcacagcgccaccggcttcaagcagagcagcaacctgtactgcaccctggaggtggacagcttcggctacttcgtgaacaaggccaagaccagagtgtacagagacaccgccgagcccaactggaacgaggagttcgagatcgagctggagggcagccagaccctgagaatcctgtgctacgagaagtgctacaacaagaccaagatccccaaggaggacggcgagagcaccgacagactgatgggcaagggccaggtgcagctggacccccaggccctgcaggacagagactggcagagaaccgtgatcgccatgaacggcatcgaggtgaagctgagcgtgaagttcaacagcagagagttcagcctgaagagaatgcccagcagaaagcagaccggcgtgttcggcgtgaagatcgccgtggtgaccaagagagagagaagcaaggtgccctacatcgtgagacagtgcgtggaggagatcgagagaagaggcatggaggaggtgggcatctacagagtgagcggcgtggccaccgacatccaggccctgaaggccgccttcgacgtgaacaacaaggacgtgagcgtgatgatgagcgagatggacgtgaacgccatcgccggcaccctgaagctgtacttcagagagctgcccgagcccctgttcaccgacgagttctaccccaacttcgccgagggcatcgccctgagcgaccccgtggccaaggagagctgcatgctgaacctgctgctgagcctgcccgaggccaacctgctgaccttcctgttcctgctggaccacctgaagagagtggccgagaaggaggccgtgaacaagatgagcctgcacaacctggccaccgtgttcggccccaccctgctgagacccagcgagaaggagagcaagctgcccgccaaccccagccagcccatcaccatgaccgacagctggagcctggaggtgatgagccaggtgcaggtgctgctgtacttcctgcagctggaggccatccccgcccccgacagcaagagacagagcatcctgttcagcaccgaggtgtag

SEQ ID NO: 9612 - DNA, 3684 bp, Artificial Sequence
  Description of Artificial Sequence: Synthetic coding sequence
atggtggaccccgtgggcttcgccgaggcctggaaggcccagttccccgacagcgagccccccagaatggagctgagaagcgtgggcgacatcgagcaggagctggagagatgcaaggccagcatcagaagactggagcaggaggtgaaccaggagagattcagaatgatctacctgcagaccctgctggccaaggagaagaagagctacgacagacagagatggggcttcagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcgtggccgccctgagaagcaacttcgagagaatcagaaagggccacggccagcccggcgccgacgccgagaagcccttctacgtgaacgtggagttccaccacgagagaggcctggtgaaggtgaacgacaaggaggtgagcgacagaatcagcagcctgggcagccaggccatgcagatggagagaaagaagagccagcacggcgccggcagcagcgtgggcgacgccagcagacccccctacagaggcagaagcagcgagagcagctgcggcgtggacggcgactacgaggacgccgagctgaaccccagattcctgaaggacaacctgatcgacgccaacggcggcagcagacccccctggccccccctggagtaccagccctaccagagcatctacgtgggcggcatgatggagggcgagggcaagggccccctgctgagaagccagagcaccagcgagcaggagaagagactgacctggcccagaagaagctacagccccagaagcttcgaggactgcggcggcggctacacccccgactgcagcagcaacgagaacctgaccagcagcgaggaggacttcagcagcggccagagcagcagagtgagccccagccccaccacctacagaatgttcagagacaagagcagaagccccagccagaacagccagcagagcttcgacagcagcagcccccccaccccccagtgccacaagagacacagacactgccccgtggtggtgagcgaggccaccatcgtgggcgtgagaaagaccggccagatctggcccaacgacggcgagggcgccttccacggcgacgccgacggcagcttcggcaccccccccggctacggctgcgccgccgacagagccgaggagcagagaagacaccaggacggcctgccctacatcgacgacagccccagcagcagcccccacctgagcagcaagggcagaggcagcagagacgccctggtgagcggcgccctggagagcaccaaggccagcgagctggacctggagaagggcctggagatgagaaagtgggtgctgagcggcatcctggccagcgaggagacctacctgagccacctggaggccctgctgctgcccatgaagcccctgaaggccgccgccaccaccagccagcccgtgctgaccagccagcagatcgagaccatcttcttcaaggtgcccgagctgtacgagatccacaaggagttctacgacggcctgttccccagagtgcagcagtggagccaccagcagagagtgggcgacctgttccagaagctggccagccagctgggcgtgtacagagccttcgtggacaactacggcgtggccatggagatggccgagaagtgctgccaggccaacgcccagttcgccgagatcagcgagaacctgagagccagaagcaacaaggacgccaaggaccccaccaccaagaacagcctggagaccctgctgtacaagcccgtggacagagtgaccagaagcaccctggtgctgcacgacctgctgaagcacacccccgccagccaccccgaccaccccctgctgcaggacgccctgagaatcagccagaacttcctgagcagcatcaacgaggagatcacccccagaagacagagcatgaccgtgaagaagggcgagcacagacagctgctgaaggacagcttcatggtggagctggtggagggcgccagaaagctgagacacgtgttcctgttcaccgacctgctgctgtgcaccaagctgaagaagcagagcggcggcaagacccagcagtacgactgcaagtggtacatccccctgaccgacctgagcttccagatggtggacgagctggaggccgtgcccaacatccccctggtgcccgacgaggagctggacgccctgaagatcaagatcagccagatcaagaacgacatccagagagagaagagagccaacaagggcagcaaggccaccgagagactgaagaagaagctgagcgagcaggagagcctgctgctgctgatgagccccagcatggccttcagagtgcacagcagaaacggcaagagctacaccttcctgatcagcagcgactacgagagagccgagtggagagagaacatcagagagcagcagaagaagtgcttcagaagcttcagcctgaccagcgtggagctgcagatgctgaccaacagctgcgtgaagctgcagaccgtgcacagcatccccctgaccatcaacaaggaggacgacgagagccccggcctgtacggcttcctgaacgtgatcgtgcacagcgccaccggcttcaagcagagcagcaacctgtactgcaccctggaggtggacagcttcggctacttcgtgaacaaggccaagaccagagtgtacagagacaccgccgagcccaactggaacgagctggacccccaggccctgcaggacagagactggcagagaaccgtgatcgccatgaacggcatcgaggtgaagctgagcgtgaagttcaacagcagagagttcagcctgaagagaatgcccagcagaaagcagaccggcgtgttcggcgtgaagatcgccgtggtgaccaagagagagagaagcaaggtgccctacatcgtgagacagtgcgtggaggagatcgagagaagaggcatggaggaggtgggcatctacagagtgagcggcgtggccaccgacatccaggccctgaaggccgccttcgacgtgaacaacaaggacgtgagcgtgatgatgagcgagatggacgtgaacgccatcgccggcaccctgaagctgtacttcagagagctgcccgagcccctgttcaccgacgagttctaccccaacttcgccgagggcatcgccctgagcgaccccgtggccaaggagagctgcatgctgaacctgctgctgagcctgcccgaggccaacctgctgaccttcctgttcctgctggaccacctgaagagagtggccgagaaggaggccgtgaacaagatgagcctgcacaacctggccaccgtgttcggccccaccctgctgagacccagcgagaaggagagcaagctgcccgccaaccccagccagcccatcaccatgaccgacagctggagcctggaggtgatgagccaggtgcaggtgctgctgtacttcctgcagctggaggccatccccgcccccgacagcaagagacagagcatcctgttcagcaccgaggtgtag

SEQ ID NO: 9613 - DNA, 1404 bp, Artificial Sequence
  Description of Artificial Sequence: Synthetic coding sequence
atggtggaccccgtgggcttcgccgaggcctggaaggcccagttccccgacagcgagccccccagaatggagctgagaagcgtgggcgacatcgagcaggagctggagagatgcaaggccagcatcagaagactggagcaggaggtgaaccaggagagattcagaatgatctacctgcagaccctgctggccaaggagaagaagagctacgacagacagagatggggcttcagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcgtggccgccctgagaagcaacttcgagagaatcagaaagggccacggccagcccggcgccgacgccgagaagcccttctacgtgaacgtggagttccaccacgagagaggcctggtgaaggtgaacgacaaggaggtgagcgacagaatcagcagcctgggcagccaggccatgcagatggagagaaagaagagccagcacggcgccggcagcagcgtgggcgacgccagcagacccccctacagaggcagaagcagcgagagcagctgcggcgtggacggcgactacgaggacgccgagctgaaccccagattcctgaaggacaacctgatcgacgccaacggcggcagcagacccccctggccccccctggagtaccagccctaccagagcatctacgtgggcggcatgatggagggcgagggcaagggccccctgctgagaagccagagcaccagcgagcaggagaagagactgacctggcccagaagaagctacagccccagaagcttcgaggactgcggcggcggctacacccccgactgcagcagcaacgagaacctgaccagcagcgaggaggacttcagcagcggccagagcagcagagtgagccccagccccaccacctacagaatgttcagagacaagagcagaagccccagccagaacagccagcagagcttcgacagcagcagcccccccaccccccagtgccacaagagacacagacactgccccgtggtggtgagcgaggccaccatcgtgggcgtgagaaagaccggccagatctggcccaacgacggcgagggcgccttccacggcgacgccgtgctgaagaccgaggtgccccaccagggcgtgagaagagccagactgagcctggaggccctgggcgaggaccccagcttcctgttccccgccagcgacggccccagacacagcagcacctggtag

SEQ ID NO: 9614 - DNA, 1365 bp, Artificial Sequence
  Description of Artificial Sequence: Synthetic coding sequence
atggtggaccccgtgggcttcgccgaggcctggaaggcccagttccccgacagcgagccccccagaatggagctgagaagcgtgggcgacatcgagcaggagctggagagatgcaaggccagcatcagaagactggagcaggaggtgaaccaggagagattcagaatgatctacctgcagaccctgctggccaaggagaagaagagctacgacagacagagatggggcttcagaagagccgcccaggcccccgacggcgccagcgagcccagagccagcgccagcagaccccagcccgcccccgccgacggcgccgaccccccccccgccgaggagcccgaggccagacccgacggcgagggcagccccggcaaggccagacccggcaccgccagaagacccggcgccgccgccagcggcgagagagacgacagaggcccccccgccagcgtggccgccctgagaagcaacttcgagagaatcagaaagggccacggccagcccggcgccgacgccgagaagcccttctacgtgaacgtggagttccaccacgagagaggcctggtgaaggtgaacgacaaggaggtgagcgacagaatcagcagcctgggcagccaggccatgcagatggagagaaagaagagccagcacggcgccggcagcagcgtgggcgacgccagcagacccccctacagaggcagaagcagcgagagcagctgcggcgtggacggcgactacgaggacgccgagctgaaccccagattcctgaaggacaacctgatcgacgccaacggcggcagcagacccccctggccccccctggagtaccagccctaccagagcatctacgtgggcggcatgatggagggcgagggcaagggccccctgctgagaagccagagcaccagcgagcaggagaagagactgacctggcccagaagaagctacagccccagaagcttcgaggactgcggcggcggctacacccccgactgcagcagcaacgagaacctgaccagcagcgaggaggacttcagcagcggccagagcagcagagtgagccccagccccaccacctacagaatgttcagagacaagagcagaagccccagccagaacagccagcagagcttcgacagcagcagcccccccaccccccagtgccacaagagacacagacactgccccgtggtggtgagcgaggccaccatcgtgggcgtgagaaagaccggccagatctggcccaacgacggcgagggcgccttccacggcgacgccgacggcagcttcggcaccccccccggctacggctgcgccgccggcagacccccccacctgaccgagctgcccgtgcagcaccagtag

SEQ ID NO: 9615 - DNA, 4704 bp, Artificial Sequence
  Description of Artificial Sequence: Synthetic coding sequence
atgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9616 - DNA, 4875 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9617 - DNA, 2043 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9618 - DNA, 2166 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9619 - DNA, 4797 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaagggcgtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9620 - DNA, 5592 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9621 - DNA, 2139 bp, Artificial Sequence
  Description of Artificial Sequence: Synthetic coding sequence
atgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9622 - DNA, 5655 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggacagccacatccacggccagagaaacaacagcatgttcagcaagagacccagagagcacatcagcgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9623 - DNA, 192 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtag

SEQ ID NO: 9624 - DNA, 192 bp, Artificial Sequence; identical to SEQ ID NO: 9623
  Description of Artificial Sequence: Synthetic coding sequence

SEQ ID NO: 9625 - DNA, 2100 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccggctgcccccccaactgcggctgcgccgccagatgcctggacagaggccagtggctgccctgcaactgggccgacgtgtag

SEQ ID NO: 9626 - DNA, 1950 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagtag

SEQ ID NO: 9627 - DNA, 5658 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggacagccacatccacggccagagaaacaacagcatgttcagcaagagacccagagagcacatcagcgccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9628 - DNA, 669 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaagtag

SEQ ID NO: 9629 - DNA, 1869 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgagtag

SEQ ID NO: 9630 - DNA, 1872 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagtag

SEQ ID NO: 9631 - DNA, 1497 bp, Artificial Sequence
  Description of Artificial Sequence: Synthetic coding sequence
gagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctggagaccagcctgagcgtgcagctgagcaacctgggcaccgtgagaaccctgagaaccaagcagagaatccagccccagaagaccagcgtgtacatcgagctggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagtag

SEQ ID NO: 9632 - DNA, 297 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatctag

SEQ ID NO: 9633 - DNA, 2280 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9634 - DNA, 180 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaaggtgctgctgtgctgccccagctggagcaccgtggtgagaagctag

SEQ ID NO: 9635 - DNA, 5451 bp, Artificial Sequence
  Description of Artificial Sequence: Synthetic coding sequence
atgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaacctgagccacgtgaccgagaacctgatcatcggcgccttcgtgaccgagccccagatcatccaggagagacccctgaccaacaagctgaagagaaagagaagacccaccagcggcctgcaccccgaggacttcatcaagaaggccgacctggccgtgcagaagacccccgagatgatcaaccagggcaccaaccagaccgagcagaacggccaggtgatgaacatcaccaacagcggccacgagaacaagaccaagggcgacagcatccagaacgagaagaaccccaaccccatcgagagcctggagaaggagagcgccttcaagaccaaggccgagcccatcagcagcagcatcagcaacatggagctggagctgaacatccacaacagcaaggcccccaagaagaacagactgagaagaaagagcagcaccagacacatccacgccctggagctggtggtgagcagaaacctgagcccccccaactgcaccgagctgcagatcgacagctgcagcagcagcgaggagatcaagaagaagaagtacaaccagatgcccgtgagacacagcagaaacctgcagctgatggagggcaaggagcccgccaccggcgccaagaagagcaacaagcccaacgagcagaccagcaagagacacgacagcgacaccttccccgagctgaagctgaccaacgcccccggcagcttcaccaagtgcagcaacaccagcgagctgaaggagttcgtgaaccccagcctgcccagagaggagaaggaggagaagctggagaccgtgaaggtgagcaacaacgccgaggaccccaaggacctgatgctgagcggcgagagagtgctgcagaccgagagaagcgtggagagcagcagcatcagcctggtgcccggcaccgactacggcacccaggagagcatcagcctgctggaggtgagcaccctgggcaaggccaagaccgagcccaacaagtgcgtgagccagtgcgccgccttcgagaaccccaagggcctgatccacggctgcagcaaggacaacagaaacgacaccgagggcttcaagtaccccctgggccacgaggtgaaccacagcagagagaccagcatcgagatggaggagagcgagctggacgcccagtacctgcagaacaccttcaaggtgagcaagagacagagcttcgcccccttcagcaaccccggcaacgccgaggaggagtgcgccaccttcagcgcccacagcggcagcctgaagaagcagagccccaaggtgaccttcgagtgcgagcagaaggaggagaaccagggcaagaacgagagcaacatcaagcccgtgcagaccgtgaacatcaccgccggcttccccgtggtgggccagaaggacaagcccgtggacaacgccaagtgcagcatcaagggcggcagcagattctgcctgagcagccagttcagaggcaacgagaccggcctgatcacccccaacaagcacggcctgctgcagaacccctacagaatcccccccctgttccccatcaagagcttcgtgaagaccaagtgcaagaagaacctgctggaggagaacttcgaggagcacagcatgagccccgagagagagatgggcaacgagaacatccccagcaccgtgagcaccatcagcagaaacaacatcagagagaacgtgttcaaggaggccagcagcagcaacatcaacgaggtgggcagcagcaccaacgaggtgggcagcagcatcaacgagatcggcagcagcgacgagaacatccaggccgagctgggcagaaacagaggccccaagctgaacgccatgctgagactgggcgtgctgcagcccgaggtgtacaagcagagcctgcccggcagcaactgcaagcaccccgagatcaagaagcaggagtacgaggaggtggtgcagaccgtgaacaccgacttcagcccctacctgatcagcgacaacctggagcagcccatgggcagcagccacgccagccaggtgtgcagcgagacccccgacgacctgctggacgacggcgagatcaaggaggacaccagcttcgccgagaacgacatcaaggagagcagcgccgtgttcagcaagagcgtgcagaagggcgagctgagcagaagccccagccccttcacccacacccacctggcccagggctacagaagaggcgccaagaagctggagagcagcgaggagaacctgagcagcgaggacgaggagctgccctgcttccagcacctgctgttcggcaaggtgaacaacatccccagccagagcaccagacacagcaccgtggccaccgagtgcctgagcaagaacaccgaggagaacctgctgagcctgaagaacagcctgaacgactgcagcaaccaggtgatcctggccaaggccagccaggagcaccacctgagcgaggagaccaagtgcagcgccagcctgttcagcagccagtgcagcgagctggaggacctgaccgccaacaccaacacccaggaccccttcctgatcggcagcagcaagcagatgagacaccagagcgagagccagggcgtgggcctgagcgacaaggagctggtgagcgacgacgaggagagaggcaccggcctggaggagaacaaccaggaggagcagagcatggacagcaacctgggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagcatcaaggagagaaagatgctgaacgagcacgacttcgaggtgagaggcgacgtggtgaacggcagaaaccaccagggccccaagagagccagagagagccaggacagaaagatcttcagaggcctggagatctgctgctacggccccttcaccaacatgcccaccgaccagctggagtggatggtgcagctgtgcggcgccagcgtggtgaaggagctgagcagcttcaccctgggcaccggcgtgcaccccatcgtggtggtgcagcccgacgcctggaccgaggacaacggcttccacgccatcggccagatgtgcgaggcccccgtggtgaccagagagtgggtgctggacagcgtggccctgtaccagtgccaggagctggacacctacctgatcccccagatcccccacagccactactag

SEQ ID NO: 9636 - DNA, 1719 bp, Artificial Sequence
  Description of Artificial Sequence: Synthetic coding sequence
atgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcgaggccgccagcggctgcgagagcgagaccagcgtgagcgaggactgcagcggcctgagcagccagagcgacatcctgaccacccagcagagagacaccatgcagcacaacctgatcaagctgcagcaggagatggccgagctggaggccgtgctggagcagcacggcagccagcccagcaacagctaccccagcatcatcagcgacagcagcgccctggaggacctgagaaaccccgagcagagcaccagcgagaaggccgtgctgaccagccagaagagcagcgagtaccccatcagccagaaccccgagggcctgagcgccgacaagttcgaggtgagcgccgacagcagcaccagcaagaacaaggagcccggcgtggagagaagcagccccagcaagtgccccagcctggacgacagatggtacatgcacagctgcagcggcagcctgcagaacagaaactaccccagccaggaggagctgatcaaggtggtggacgtggaggagcagcagctggaggagagcggcccccacgacctgaccgagaccagctacctgcccagacaggacctggagggcaccccctacctggagagcggcatcagcctgttcagcgacgaccccgagagcgaccccagcgaggacagagcccccgagagcgccagagtgggcaacatccccagcagcaccagcgccctgaaggtgccccagctgaaggtggccgagagcgcccagagccccgccgccgcccacaccaccgacaccgccggctacaacgccatggaggagagcgtgagcagagagaagcccgagctgaccgccagcaccgagagagtgaacaagagaatgagcatggtggtgagcggcctgacccccgaggagttcatgctggtgtacaagttcgccagaaagcaccacatcaccctgaccaacctgatcaccgaggagaccacccacgtggtgatgaagaccgacgccgagttcgtgtgcgagagaaccctgaagtacttcctgggcatcgccggcggcaagtgggtggtgagctacttctgggtgacccagagctag

SEQ ID NO: 9637 - DNA, 1422 bp, Artificial Sequence
  Description of Artificial Sequence: Synthetic coding sequence
atggacctgagcgccctgagagtggaggaggtgcagaacgtgatcaacgccatgcagaagatcctggagtgccccatctgcctggagctgatcaaggagcccgtgagcaccaagtgcgaccacatcttctgcaagttctgcatgctgaagctgctgaaccagaagaagggccccagccagtgccccctgtgcaagaacgacatcaccaagagaagcctgcaggagagcaccagattcagccagctggtggaggagctgctgaagatcatctgcgccttccagctggacaccggcctggagtacgccaacagctacaacttcgccaagaaggagaacaacagccccgagcacctgaaggacgaggtgagcatcatccagagcatgggctacagaaacagagccaagagactgctgcagagcgagcccgagaaccccagcctgcaggagaccagcctgagcgtgcagctgagcaacctgggcaccgtgagaaccctgagaaccaagcagagaatccagccccagaagaccagcgtgtacatcgagctgggcagcgacagcagcgaggacaccgtgaacaaggccacctactgcagcgtgggcgaccaggagctgctgcagatcaccccccagggcaccagagacgagatcagcctggacagcgccaagaaggccgcctgcgagttcagcgagaccgacgtgaccaacaccgagcaccaccagcccagcaacaacgacctgaacaccaccgagaagagagccgccgagagacaccccgagaagtaccagggcagcagcgtgagcaacctgcacgtggagccctgcggcaccaacacccacgccagcagcctgcagcacgagaacagcagcctgctgctgaccaaggacagaatgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaactag

SEQ ID NO: 9638 - DNA, 534 bp, Artificial Sequence
  Description of Artificial Sequence: Synthetic coding sequence
atgaacgtggagaaggccgagttctgcaacaagagcaagcagcccggcctggccagaagccagcacaacagatgggccggcagcaaggagacctgcaacgacagaagaacccccagcaccgagaagaaggtggacctgaacgccgaccccctgtgcgagagaaaggagtggaacaagcagaagctgccctgcagcgagaaccccagagacaccgaggacgtgccctggatcaccctgaacagcagcatccagaaggtgaacgagtggttcagcagaagcgacgagctgctgggcagcgacgacagccacgacggcgagagcgagagcaacgccaaggtggccgacgtgctggacgtgctgaacgaggtggacgagtacagcggcagcagcgagaagatcgacctgctggccagcgacccccacgaggccctgatctgcaagagcgagagagtgcacagcaagagcgtggagagcaacatcgaggacaagatcttcggcaagacctacagaaagaaggccagcctgcccaactag

SEQ ID NO: 9639 - DNA, 10257 bp, Artificial Sequence
  Description of Artificial Sequence: Synthetic coding sequence
atgcccatcggcagcaaggagagacccaccttcttcgagatcttcaagaccagatgcaacaaggccgacctgggccccatcagcctgaactggttcgaggagctgagcagcgaggcccccccctacaacagcgagcccgccgaggagagcgagcacaagaacaacaactacgagcccaacctgttcaagaccccccagagaaagcccagctacaaccagctggccagcacccccatcatcttcaaggagcagggcctgaccctgcccctgtaccagagccccgtgaaggagctggacaagttcaagctggacctgggcagaaacgtgcccaacagcagacacaagagcctgagaaccgtgaagaccaagatggaccaggccgacgacgtgagctgccccctgctgaacagctgcctgagcgagagccccgtggtgctgcagtgcacccacgtgaccccccagagagacaagagcgtggtgtgcggcagcctgttccacacccccaagttcgtgaagggcagacagacccccaagcacatcagcgagagcctgggcgccgaggtggaccccgacatgagctggagcagcagcctggccaccccccccaccctgagcagcaccgtgctgatcgtgagaaacgaggaggccagcgagaccgtgttcccccacgacaccaccgccaacgtgaagagctacttcagcaaccacgacgagagcctgaagaagaacgacagattcatcgccagcgtgaccgacagcgagaacaccaaccagagagaggccgccagccacggcttcggcaagaccagcggcaacagcttcaaggtgaacagctgcaaggaccacatcggcaagagcatgcccaacgtgctggaggacgaggtgtacgagaccgtggtggacaccagcgaggaggacagcttcagcctgtgcttcagcaagtgcagaaccaagaacctgcagaaggtgagaaccagcaagaccagaaagaagatcttccacgaggccaacgccgacgagtgcgagaagagcaagaaccaggtgaaggagaagtacagcttcgtgagcgaggtggagcccaacgacaccgaccccctggacagcaacgtggccaaccagaagcccttcgagagcggcagcgacaagatcagcaaggaggtggtgcccagcctggcctgcgagtggagccagctgaccctgagcggcctgaacggcgcccagatggagaagatccccctgctgcacatcagcagctgcgaccagaacatcagcgagaaggacctgctggacaccgagaacaagagaaagaaggacttcctgaccagcgagaacagcctgcccagaatcagcagcctgcccaagagcgagaagcccctgaacgaggagaccgtggtgaacaagagagacgaggagcagcacctggagagccacaccgactgcatcctggccgtgaagcaggccatcagcggcaccagccccgtggccagcagcttccagggcatcaagaagagcatcttcagaatcagagagagccccaaggagaccttcaacgccagcttcagcggccacatgaccgaccccaacttcaagaaggagaccgaggccagcgagagcggcctggagatccacaccgtgtgcagccagaaggaggacagcctgtgccccaacctgatcgacaacggcagctggcccgccaccaccacccagaacagcgtggccctgaagaacgccggcctgatcagcaccctgaagaagaagaccaacaagttcatctacgccatccacgacgagaccagctacaagggcaagaagatccccaaggaccagaagagcgagctgatcaactgcagcgcccagttcgaggccaacgccttcgaggcccccctgaccttcgccaacgccgacagcggcctgctgcacagcagcgtgaagagaagctgcagccagaacgacagcgaggagcccaccctgagcctgaccagcagcttcggcaccatcctgagaaagtgcagcagaaacgagacctgcagcaacaacaccgtgatcagccaggacctggactacaaggaggccaagtgcaacaaggagaagctgcagctgttcatcacccccgaggccgacagcctgagctgcctgcaggagggccagtgcgagaacgaccccaagagcaagaaggtgagcgacatcaaggaggaggtgctggccgccgcctgccaccccgtgcagcacagcaaggtggagtacagcgacaccgacttccagagccagaagagcctgctgtacgaccacgagaacgccagcaccctgatcctgacccccaccagcaaggacgtgctgagcaacctggtgatgatcagcagaggcaaggagagctacaagatgagcgacaagctgaagggcaacaactacgagagcgacgtggagctgaccaagaacatccccatggagaagaaccaggacgtgtgcgccctgaacgagaactacaagaacgtggagctgctgccccccgagaagtacatgagagtggccagccccagcagaaaggtgcagttcaaccagaacaccaacctgagagtgatccagaagaaccaggaggagaccaccagcatcagcaagatcaccgtgaaccccgacagcgaggagctgttcagcgacaacgagaacaacttcgtgttccaggtggccaacgagagaaacaacctggccctgggcaacaccaaggagctgcacgagaccgacctgacctgcgtgaacgagcccatcttcaagaacagcaccatggtgctgtacggcgacaccggcgacaagcaggccacccaggtgagcatcaagaaggacctggtgtacgtgctggccgaggagaacaagaacagcgtgaagcagcacatcaagatgaccctgggccaggacctgaagagcgacatcagcctgaacatcgacaagatccccgagaagaacaacgactacatgaacaagtgggccggcctgctgggccccatcagcaaccacagcttcggcggcagcttcagaaccgccagcaacaaggagatcaagctgagcgagcacaacatcaagaagagcaagatgttcttcaaggacatcgaggagcagtaccccaccagcctggcctgcgtggagatcgtgaacaccctggccctggacaaccagaagaagctgagcaagccccagagcatcaacaccgtgagcgcccacctgcagagcagcgtggtggtgagcgactgcaagaacagccacatcaccccccagatgctgttcagcaagcaggacttcaacagcaaccacaacctgacccccagccagaaggccgagatcaccgagctgagcaccatcctggaggagagcggcagccagttcgagttcacccagttcagaaagcccagctacatcctgcagaagagcaccttcgaggtgcccgagaaccagatgaccatcctgaagaccaccagcgaggagtgcagagacgccgacctgcacgtgatcatgaacgcccccagcatcggccaggtggacagcagcaagcagttcgagggcaccgtggagatcaagagaaagttcgccggcctgctgaagaacgactgcaacaagagcgccagcggctacctgaccgacgagaacgaggtgggcttcagaggcttctacagcgcccacggcaccaagctgaacgtgagcaccgaggccctgcagaaggccgtgaagctgttcagcgacatcgagaacatcagcgaggagaccagcgccgaggtgcaccccatcagcctgagcagcagcaagtgccacgacagcgtggtgagcatgttcaagatcgagaaccacaacgacaagaccgtgagcgagaagaacaacaagtgccagctgatcctgcagaacaacatcgagatgaccaccggcaccttcgtggaggagatcaccgagaactacaagagaaacaccgagaacgaggacaacaagtacaccgccgccagcagaaacagccacaacctggagttcgacggcagcgacagcagcaagaacgacaccgtgtgcatccacaaggacgagaccgacctgctgttcaccgaccagcacaacatctgcctgaagctgagcggccagttcatgaaggagggcaacacccagatcaaggaggacctgagcgacctgaccttcctggaggtggccaaggcccaggaggcctgccacggcaacaccagcaacaaggagcagctgaccgccaccaagaccgagcagaacatcaaggacttcgagaccagcgacaccttcttccagaccgccagcggcaagaacatcagcgtggccaaggagagcttcaacaagatcgtgaacttcttcgaccagaagcccgaggagctgcacaacttcagcctgaacagcgagctgcacagcgacatcagaaagaacaagatggacatcctgagctacgaggagaccgacatcgtgaagcacaagatcctgaaggagagcgtgcccgtgggcaccggcaaccagctggtgaccttccagggccagcccgagagagacgagaagatcaaggagcccaccctgctgggcttccacaccgccagcggcaagaaggtgaagatcgccaaggagagcctggacaaggtgaagaacctgttcgacgagaaggagcagggcaccagcgagatcaccagcttcagccaccagtgggccaagaccctgaagtacagagaggcctgcaaggacctggagctggcctgcgagaccatcgagatcaccgccgcccccaagtgcaaggagatgcagaacagcctgaacaacgacaagaacctggtgagcatcgagaccgtggtgccccccaagctgctgagcgacaacctgtgcagacagaccgagaacctgaagaccagcaagagcatcttcctgaaggtgaaggtgcacgagaacgtggagaaggagaccgccaagagccccgccacctgctacaccaaccagagcccctacagcgtgatcgagaacagcgccctggccttctacaccagctgcagcagaaagaccagcgtgagccagaccagcctgctggaggccaagaagtggctgagagagggcatcttcgacggccagcccgagagaatcaacaccgccgactacgtgggcaactacctgtacgagaacaacagcaacagcaccatcgccgagaacgacaagaaccacctgagcgagaagcaggacacctacctgagcaacagcagcatgagcaacagctacagctaccacagcgacgaggtgtacaacgacagcggctacctgagcaagaacaagctggacagcggcatcgagcccgtgctgaagaacgtggaggaccagaagaacaccagcttcagcaaggtgatcagcaacgtgaaggacgccaacgcctacccccagaccgtgaacgaggacatctgcgtggaggagctggtgaccagcagcagcccctgcaagaacaagaacgccgccatcaagctgagcatcagcaacagcaacaacttcgaggtgggcccccccgccttcagaatcgccagcggcaagatcgtgtgcgtgagccacgagaccatcaagaaggtgaaggacatcttcaccgacagcttcagcaaggtgatcaaggagaacaacgagaacaagagcaagatctgccagaccaagatcatggccggctgctacgaggccctggacgacagcgaggacatcctgcacaacagcctggacaacgacgagtgcagcacccacagccacaaggtgttcgccgacatccagagcgaggagatcctgcagcacaaccagaacatgagcggcctggagaaggtgagcaagatcagcccctgcgacgtgagcctggagaccagcgacatctgcaagtgcagcatcggcaagctgcacaagagcgtgagcagcgccaacacctgcggcatcttcagcaccgccagcggcaagagcgtgcaggtgagcgacgccagcctgcagaacgccagacaggtgttcagcgagatcgaggacagcaccaagcaggtgttcagcaaggtgctgttcaagagcaacgagcacagcgaccagctgaccagagaggagaacaccgccatcagaacccccgagcacctgatcagccagaagggcttcagctacaacgtggtgaacagcagcgccttcagcggcttcagcaccgccagcggcaagcaggtgagcatcctggagagcagcctgcacaaggtgaagggcgtgctggaggagttcgacctgatcagaaccgagcacagcctgcactacagccccaccagcagacagaacgtgagcaagatcctgcccagagtggacaagagaaaccccgagcactgcgtgaacagcgagatggagaagacctgcagcaaggagttcaagctgagcaacaacctgaacgtggagggcggcagcagcgagaacaaccacagcatcaaggtgagcccctacctgagccagttccagcaggacaagcagcagctggtgctgggcaccaaggtgagcctggtggagaacatccacgtgctgggcaaggagcaggccagccccaagaacgtgaagatggagatcggcaagaccgagaccttcagcgacgtgcccgtgaagaccaacatcgaggtgtgcagcacctacagcaaggacagcgagaactacttcgagaccgaggccgtggagatcgccaaggccttcatggaggacgacgagctgaccgacagcaagctgcccagccacgccacccacagcctgttcacctgccccgagaacgaggagatggtgctgagcaacagcagaatcggcaagagaagaggcgagcccctgatcctggtgggcgagcccagcatcaagagaaacctgctgaacgagttcgacagaatcatcgagaaccaggagaagagcctgaaggccagcaagagcacccccgacggcaccatcaaggacagaagactgttcatgcaccacgtgagcctggagcccatcacctgcgtgcccttcagaaccaccaaggagagacaggagatccagaaccccaacttcaccgcccccggccaggagttcctgagcaagagccacctgtacgagcacctgaccctggagaagagcagcagcaacctggccgtgagcggccaccccttctaccaggtgagcgccaccagaaacgagaagatgagacacctgatcaccaccggcagacccaccaaggtgttcgtgccccccttcaagaccaagagccacttccacagagtggagcagtgcgtgagaaacatcaacctggaggagaacagacagaagcagaacatcgacggccacggcagcgacgacagcaagaacaagatcaacgacaacgagatccaccagttcaacaagaacaacagcaaccaggccgtggccgtgaccttcaccaagtgcgaggaggagcccctggacctgatcaccagcctgcagaacgccagagacatccaggacatgagaatcaagaagaagcagagacagagagtgttcccccagcccggcagcctgtacctggccaagaccagcaccctgcccagaatcagcctgaaggccgccgtgggcggccaggtgcccagcgcctgcagccacaagcagctgtacacctacggcgtgagcaagcactgcatcaagatcaacagcaagaacgccgagagcttccagttccacaccgaggactacttcggcaaggagagcctgtggaccggcaagggcatccagctggccgacggcggctggctgatccccagcaacgacggcaaggccggcaaggaggagttctacagagccctgtgcgacacccccggcgtggaccccaagctgatcagcagaatctgggtgtacaaccactacagatggatcatctggaagctggccgccatggagtgcgccttccccaaggagttcgccaacagatgcctgagccccgagagagtgctgctgcagctgaagtacagatacgacaccgagatcgacagaagcagaagaagcgccatcaagaagatcatggagagagacgacaccgccgccaagaccctggtgctgtgcgtgagcgacatcatcagcctgagcgccaacatcagcgagaccagcagcaacaagaccagcagcgccgacacccagaaggtggccatcatcgagctgaccgacggctggtacgccgtgaaggcccagctggacccccccctgctggccgtgctgaagaacggcagactgaccgtgggccagaagatcatcctgcacggcgccgagctggtgggcagccccgacgcctgcacccccctggaggcccccgagagcctgatgctgaagatcagcgccaacagcaccagacccgccagatggtacaccaagctgggcttcttccccgaccccagacccttccccctgcccctgagcagcctgttcagcgacggcggcaacgtgggctgcgtggacgtgatcatccagagagcctaccccatccagtggatggagaagaccagcagcggcctgtacatcttcagaaacgagagagaggaggagaaggaggccgccaagtacgtggaggcccagcagaagagactggaggccctgttcaccaagatccaggaggagttcgaggagcacgaggagaacaccaccaagccctacctgcccagcagagccctgaccagacagcaggtgagagccctgcaggacggcgccgagctgtacgaggccgtgaagaacgccgccgaccccgcctacctggagggctacttcagcgaggagcagctgagagccctgaacaaccacagacagatgctgaacgacaagaagcaggcccagatccagctggagatcagaaaggccatggagagcgccgagcagaaggagcagggcctgagcagagacgtgaccaccgtgtggaagctgagaatcgtgagctacagcaagaaggagaaggacagcgtgatcctgagcatctggagacccagcagcgacctgtacagcctgctgaccgagggcaagagatacagaatctaccacctggccaccagcaagagcaagagcaagagcgagagagccaacatccagctggccgccaccaagaagacccagtaccagcagctgcccgtgagcgacgagatcctgttccagatctaccagcccagagagcccctgcacttcagcaagttcctggaccccgacttccagcccagctgcagcgaggtggacctgatcggcttcgtggtgagcgtggtgaagaagaccggcctggcccccttcgtgtacctgagcgacgagtgctacaacctgctggccatcaagttctggatcgacctgaacgaggacatcatcaagccccacatgctgatcgccgccagcaacctgcagtggagacccgagagcaagagcggcctgctgaccctgttcgccggcgacttcagcgtgttcagcgccagccccaaggagggccacttccaggagaccttcaacaagatgaagaacaccgtggagaacatcgacatcctgtgcaacgaggccgagaacaagctgatgcacatcctgcacgccaacgaccccaagtggagcacccccaccaaggactgcaccagcggcccctacaccgcccagatcatccccggcaccggcaacaagctgctgatgagcagccccaactgcgagatctactaccagagccccctgagcctgtgcatggccaagagaaagagcgtgagcacccccgtgagcgcccagatgaccagcaagagctgcaagggcgagaaggagatcgacgaccagaagaactgcaagaagagaagagccctggacttcctgagcagactgcccctgcccccccccgtgagccccatctgcaccttcgtgagccccgccgcccagaaggccttccagccccccagaagctgcggcaccaagtacgagacccccatcaagaagaaggagctgaacagcccccagatgacccccttcaagaagttcaacgagatcagcctgctggagagcaacagcatcgccgacgaggagctggccctgatcaacacccaggccctgctgagcggcagcaccggcgagaagcagttcatcagcgtgagcgagagcaccagaaccgcccccaccagcagcgaggactacctgagactgaagagaagatgcaccaccagcctgatcaaggagcaggagagcagccaggccagcaccgaggagtgcgagaagaacaagcaggacaccatcaccaccaagaagtacatctag

SEQ ID NO: 9640 - DNA, 1809 bp, Artificial Sequence
  Description of Artificial Sequence: Synthetic coding sequence
atgcccatcggcagcaaggagagacccaccttcttcgagatcttcaagaccagatgcaacaaggccggccccatcagcctgaactggttcgaggagctgagcagcgaggcccccccctacaacagcgagcccgccgaggagagcgagcacaagaacaacaactacgagcccaacctgttcaagaccccccagagaaagcccagctacaaccagctggccagcacccccatcatcttcaaggagcagggcctgaccctgcccctgtaccagagccccgtgaaggagctggacaagttcaagctggacctgggcagaaacgtgcccaacagcagacacaagagcctgagaaccgtgaagaccaagatggaccaggccgacgacgtgagctgccccctgctgaacagctgcctgagcgagagccccgtggtgctgcagtgcacccacgtgaccccccagagagacaagagcgtggtgtgcggcagcctgttccacacccccaagttcgtgaagggcagacagacccccaagcacatcagcgagagcctgggcgccgaggtggaccccgacatgagctggagcagcagcctggccaccccccccaccctgagcagcaccgtgctgatcgtgagaaacgaggaggccagcgagaccgtgttcccccacgacaccaccgccaacgtgaagagctacttcagcaaccacgacgagagcctgaagaagaacgacagattcatcgccagcgtgaccgacagcgagaacaccaaccagagagaggccgccagccacggcttcggcaagaccagcggcaacagcttcaaggtgaacagctgcaaggaccacatcggcaagagcatgcccaacgtgctggaggacgaggtgtacgagaccgtggtggacaccagcgaggaggacagcttcagcctgtgcttcagcaagtgcagaaccaagaacctgcagaaggtgagaaccagcaagaccagaaagaagatcttccacgaggccaacgccgacgagtgcgagaagagcaagaaccaggtgaaggagaagtacagcttcgtgagcgaggtggagcccaacgacaccgaccccctggacagcaacgtggccaaccagaagcccttcgagagcggcagcgacaagatcagcaaggaggtggtgcccagcctggcctgcgagtggagccagctgaccctgagcggcctgaacggcgcccagatggagaagatccccctgctgcacatcagcagctgcgaccagaacatcagcgagaaggacctgctggacaccgagaacaagagaaagaaggacttcctgaccagcgagaacagcctgcccagaatcagcagcctgcccaagagcgagaagcccctgaacgaggagaccgtggtgaacaagagagacgaggagcagcacctggagagccacaccgactgcatcctggccgtgaagcaggccatcagcggcaccagccccgtggccagcagcttccagggcatcaagaagagcatcttcagaatcagagagagccccaaggagaccttcaacgccagcttcagcggccacatgaccgaccccaacttcaagaaggagaccgaggccagcgagagcggcctggagatccacaccgtgtgcagccagaaggaggacagcctgtgccccaacctgatcgacaacggcagctggcccgccaccaccacccagaacagcgtggccctgaagaacgccggcctgatcagcaccctgaagaagaagaccaacaagttcatctacgccatccacgacgagaccagctacaagggcaagaagtag

SEQ ID NO: 9641 - DNA, 10257 bp, Artificial Sequence; identical to SEQ ID NO: 9639
  Description of Artificial Sequence: Synthetic coding sequence

SEQ ID NO: 9642 - DNA, 2667 bp, Artificial Sequence
  Description of Artificial Sequence: Synthetic coding sequence
atgcactgccccggcgaggcccccctggccgcccccagacccacccccaaggacccctgcctgagaaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9643 - DNA, 2613 bp, Artificial Sequence
  Description of Artificial Sequence: Synthetic coding sequence
atgaaccacctgaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9644 - DNA, 2667 bp, Artificial Sequence
  Description of Artificial Sequence: Synthetic coding sequence
atgaaccacctgaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgagcaagtgccagggcaacgccagagccagactgagactgtggggcgtgtgggtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9645 - DNA, 2751 bp, Artificial Sequence
  Description of Artificial Sequence: Synthetic coding sequence
atgcccgccaagcccttcctgagcagcgtgctgctgagctggaaggtgctggacttcagcggccccggcccccagggcaccggccagccctgcagctgcggccactgggccgagggccagggcggcccccccgagcccgccggcggccccaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9646 - DNA, 2667 bp, Artificial Sequence
  Description of Artificial Sequence: Synthetic coding sequence
atgctgacccacagaccccaggaggccgagcagagaggcagaacccccggccccagcttcgagtggaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9647 - DNA, 2169 bp, Artificial Sequence
  Description of Artificial Sequence: Synthetic coding sequence
atgcagggcaagaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9648 - DNA, 2613 bp, Artificial Sequence
  Description of Artificial Sequence: Synthetic coding sequence
atgagcgtgcccaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9649 - DNA, 2607 bp, Artificial Sequence
  Description of Artificial Sequence: Synthetic coding sequence
atggagaacgtgctggccaaggccctgtacgacaacgtggccgagagccccgacgagctgagcttcagaaagggcgacatcatgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9650 - DNA, 2526 bp, Artificial Sequence
  Description of Artificial Sequence: Synthetic coding sequence
atgaccgtgctggagcaggacacccagggcctggacggctggtggctgtgcagcctgcacggcagacagggcatcgtgcccggcaacagactgaagatcctggtgggcatgtacgacaagaagcccgccggccccggccccggcccccccgccacccccgcccagccccagcccggcctgcacgcccccgccccccccgccagccagtacacccccatgctgcccaacacctaccagccccagcccgacagcgtgtacctggtgcccacccccagcaaggcccagcagggcctgtaccaggtgcccggccccagcccccagttccagagcccccccgccaagcagaccagcaccttcagcaagcagaccccccaccaccccttccccagccccgccaccgacctgtaccaggtgccccccggccccggcggccccgcccaggacatctaccaggtgccccccagcgccggcatgggccacgacatctaccaggtgccccccagcatggacaccagaagctgggagggcaccaagccccccgccaaggtggtggtgcccaccagagtgggccagggctacgtgtacgaggccgcccagcccgagcaggacgagtacgacatccccagacacctgctggcccccggcccccaggacatctacgacgtgccccccgtgagaggcctgctgcccagccagtacggccaggaggtgtacgacaccccccccatggccgtgaagggccccaacggcagagaccccctgctggaggtgtacgacgtgccccccagcgtggagaagggcctgccccccagcaaccaccacgccgtgtacgacgtgccccccagcgtgagcaaggacgtgcccgacggccccctgctgagagaggagacctacgacgtgccccccgccttcgccaaggccaagcccttcgaccccgccagaacccccctggtgctggccgcccccccccccgacagcccccccgccgaggacgtgtacgacgtgcccccccccgcccccgacctgtacgacgtgccccccggcctgagaagacccggccccggcaccctgtacgacgtgcccagagagagagtgctgccccccgaggtggccgacggcggcgtggtggacagcggcgtgtacgccgtgcccccccccgccgagagagaggcccccgccgagggcaagagactgagcgccagcagcaccggcagcaccagaagcagccagagcgccagcagcctggaggtggccggccccggcagagagcccctggagctggaggtggccgtggaggccctggccagactgcagcagggcgtgagcgccaccgtggcccacctgctggacctggccggcagcgccggcgccaccggcagctggagaagccccagcgagccccaggagcccctggtgcaggacctgcaggccgccgtggccgccgtgcagagcgccgtgcacgagctgctggagttcgccagaagcgccgtgggcaacgccgcccacaccagcgacagagccctgcacgccaagctgagcagacagctgcagaagatggaggacgtgcaccagaccctggtggcccacggccaggccctggacgccggcagaggcggcagcggcgccaccctggaggacctggacagactggtggcctgcagcagagccgtgcccgaggacgccaagcagctggccagcttcctgcacggcaacgccagcctgctgttcagaagaaccaaggccaccgcccccggccccgagggcggcggcaccctgcaccccaaccccaccgacaagaccagcagcatccagagcagacccctgcccagcccccccaagttcaccagccaggacagccccgacggccagtacgagaacagcgagggcggctggatggaggactacgactacgtgcacctgcagggcaaggaggagttcgagaagacccagaaggagctgctggagaagggcagcatcaccagacagggcaagagccagctggagctgcagcagctgaagcagttcgagagactggagcaggaggtgagcagacccatcgaccacgacctggccaactggacccccgcccagcccctggcccccggcagaaccggcggcctgggccccagcgacagacagctgctgctgttctacctggagcagtgcgaggccaacctgaccaccctgaccaacgccgtggacgccttcttcaccgccgtggccaccaaccagccccccaagatcttcgtggcccacagcaagttcgtgatcctgagcgcccacaagctggtgttcatcggcgacaccctgagcagacaggccaaggccgccgacgtgagaagccaggtgacccactacagcaacctgctgtgcgacctgctgagaggcatcgtggccaccaccaaggccgccgccctgcagtaccccagccccagcgccgcccaggacatggtggagagagtgaaggagctgggccacagcacccagcagttcagaagagtgctgggccagctggccgccgcctag

SEQ ID NO: 9651 - DNA, 741 bp, Artificial Sequence
  Description of Artificial Sequence: Synthetic coding sequence
atgcccgtgcagccccccagcaaggacaccgaggagatggaggccgagggcgacagcgccgccgagatgaacggcgaggaggaggagagcgaggaggagagaagcggcagccagaccgagagcgaggaggagagcagcgagatggacgacgaggactacgagagaagaagaagcgagtgcgtgagcgagatgctggacctggagaagcagttcagcgagctgaaggagaagctgttcagagagagactgagccagctgagactgagactggaggaggtgggcgccgagagagcccccgagtacaccgagcccctgggcggcctgcagagaagcctgaagatcagaatccaggtggccggcatctacaagggcttctgcctggacgtgatcagaaacaagtacgagtgcgagctgcagggcgccaagcagcacctggagagcgagaagctgctgctgtacgacaccctgcagggcgagctgcaggagagaatccagagactggaggaggacagacagagcctggacctgagcagcgagtggtgggacgacaagctgcacgccagaggcagcagcagaagctgggacagcctgccccccagcaagagaaagaaggcccccctggtgagcggcccctacatcgtgtacatgctgcaggagatcgacatcctggaggactggaccgccatcaagaaggccagagccgccgtgagcccccagaagagaaagagcgacggcccctag

SEQ ID NO: 9652 - DNA, 873 bp, Artificial Sequence
  Description of Artificial Sequence: Synthetic coding sequence
atgcccgtgcagccccccagcaaggacaccgaggagatggaggccgagggcgacagcgccgccgagatgaacggcgaggaggaggagagcgaggaggagagaagcggcagccagaccgagagcgaggaggagagcagcgagatggacgacgaggactacgagagaagaagaagcgagtgcgtgagcgagatgctggacctggagaagcagttcagcgagctgaaggagaagctgttcagagagagactgagccagctgagactgagactggaggaggtgggcgccgagagagcccccgagtacaccgagcccctgggcggcctgcagagaagcctgaagatcagaatccaggtggccggcatctacaagggcttctgcctggacgtgatcagaaacaagtacgagtgcgagctgcagggcgccaagcagcacctggagagcgagaagctgctgctgtacgacaccctgcagggcgagctgcaggagagaatccagagactggaggaggacagacagagcctggacctgagcagcgagtggtgggacgacaagctgcacgccagaggcagcagcagaagctgggacagcctgccccccagcaagagaaagaaggcccccctggtgagcggcccctacatcgtgtacatgctgcaggagatcgacatcctggaggactggaccgccatcaagaaggccagagccgccgtgagcccccagaagagaaagagcgacgacagaagaacccacagacccctgagagtgtgccccgccagactgctgtggtgctgctgggccctgcccctgcacctggccctggcctggaccccccccctgcccagcagcagacccgcccagctgtggccctggagctag

SEQ ID NO: 9653 - DNA, 735 bp, Artificial Sequence
  Description of Artificial Sequence: Synthetic coding sequence
atgcccgtgcagccccccagcaaggacaccgaggagatggaggccgagggcgacagcgccgccgagatgaacggcgaggaggaggagagcgaggaggagagaagcggcagccagaccgagagcgaggaggagagcagcgagatggacgacgaggactacgagagaagaagaagcgagtgcgtgagcgagatgctggacctggagaagcagttcagcgagctgaaggagaagctgttcagagagagactgagccagctgagactgagactggaggaggtgggcgccgagagagcccccgagtacaccgagcccctgggcggcctgcagagaagcctgaagatcagaatccaggtggccggcatctacaagggcttctgcctggacgtgatcagaaacaagtacgagtgcgagctgcagggcgccaagcagcacctggagagcgagaagctgctgctgtacgacaccctgcagggcgagctgcaggagagaatccagagactggaggaggacagacagagcctggacctgagcagcgagtggtgggacgacaagctgcacgccagaggcagcagcagaagctgggacagcctgccccccagcaagagaaagaaggcccccctggtgagcggcccctacatcgtgtacatgctgcaggagatcgacatcctggaggactggaccgccatcaagaaggccagagccgccgtgagcccccagaagagaaagagcgactag

SEQ ID NO: 9654 - DNA, 1494 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagaaagaagagcaagctgttcagcagactgagaagaaagaagaacagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagctgagaaagggcccccccgtgccccccccccccaagcacacccccagcaaggaggtgaagcaggagcagatcctgagcctgttcgaggacaccttcgtgcccgagatcagcgtgaccacccccagccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9655 - DNA, 1782 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaagcccgtgagcctgctggagaaggccgccccccagtggtgccagggcaagctgcaggcccacctggtggcccagaccaacctgctgagaaaccaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagctgagaaagggcccccccgtgccccccccccccaagcacacccccagcaaggaggtgaagcaggagcagatcctgagcctgttcgaggacaccttcgtgcccgagatcagcgtgaccacccccagccagttcgaggcccccggccccttcagcgagcaggccagcctgctggacctggacttcgaccccctgccccccgtgaccagccccgtgaaggcccccacccccagcggccagagcatcccctgggacctgtgggagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9656 - DNA, 1557 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagctgagaaagggcccccccgtgccccccccccccaagcacacccccagcaaggaggtgaagcaggagcagatcctgagcctgttcgaggacaccttcgtgcccgagatcagcgtgaccacccccagccagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9657 - DNA, 1230 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9658 - DNA, 1521 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaagcccgtgagcctgctggagaaggccgccccccagtggtgccagggcaagctgcaggcccacctggtggcccagaccaacctgctgagaaaccaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9659 - DNA, 1365 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagaaagaagagcaagctgttcagcagactgagaagaaagaagaacagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9660 - DNA, 1653 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaagcccgtgagcctgctggagaaggccgccccccagtggtgccagggcaagctgcaggcccacctggtggcccagaccaacctgctgagaaaccaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagttcgaggcccccggccccttcagcgagcaggccagcctgctggacctggacttcgaccccctgccccccgtgaccagccccgtgaaggcccccacccccagcggccagagcatcccctgggacctgtgggagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9661 - DNA, 1449 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagctgagaaagggcccccccgtgccccccccccccaagcacacccccagcaaggaggtgaagcaggagcagatcctgagcctgttcgaggacaccttcgtgcccgagatcagcgtgaccacccccagccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9662 - DNA, 1428 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagcccaccgagagccccgccggcagcctgcccagcggcgagcccagcgccgccgagggcaccttcgccgtgagctggcccagccagaccgccgagcccggccccgcccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9663 - DNA, 1320 bp, Artificial Sequence
  Description of Artificial Sequence: Synthetic coding sequence
atggccgagatgggcagcaagggcgtgaccgccggcaagatcgccagcaacgtgcagaagaagctgaccagagcccaggagaaggtgctgcagaagctgggcaaggccgacgagaccaaggacgagcagttcgagcagtgcgtgcagaacttcaacaagcagctgaccgagggcaccagactgcagaaggacctgagaacctacctggccagcgtgaaggccatgcacgaggccagcaagaagctgaacgagtgcctgcaggaggtgtacgagcccgactggcccggcagagacgaggccaacaagatcgccgagaacaacgacctgctgtggatggactaccaccagaagctggtggaccaggccctgctgaccatggacacctacctgggccagttccccgacatcaagagcagaatcgccaagagaggcagaaagctggtggactacgacagcgccagacaccactacgagagcctgcagaccgccaagaagaaggacgaggccaagatcgccaaggccgaggaggagctgatcaaggcccagaaggtgttcgaggagatgaacgtggacctgcaggaggagctgcccagcctgtggaacagcagagtgggcttctacgtgaacaccttccagagcatcgccggcctggaggagaacttccacaaggagatgagcaagctgaaccagaacctgaacgacgtgctggtgggcctggagaagcagcacggcagcaacaccttcaccgtgaaggcccagcccagcgacaacgcccccgccaagggcaacaagagccccagcccccccgacggcagccccgccgccacccccgagatcagagtgaaccacgagcccgagcccgccggcggcgccacccccggcgccaccctgcccaagagccccagccagcccgccgaggccagcgaggtggccggcggcacccagcccgccgccggcgcccaggagcccggcgagaccgccgccagcgaggccgccagcagcagcctgcccgccgtggtggtggagaccttccccgccaccgtgaacggcaccgtggagggcggcagcggcgccggcagactggacctgccccccggcttcatgttcaaggtgcaggcccagcacgactacaccgccaccgacaccgacgagctgcagctgaaggccggcgacgtggtgctggtgatccccttccagaaccccgaggagcaggacgagggctggctgatgggcgtgaaggagagcgactggaaccagcacaaggagctggagaagtgcagaggcgtgttccccgagaacttcaccgagagagtgccctag

SEQ ID NO: 9664 - DNA, 1956 bp, Artificial Sequence
  Description of Artificial Sequence: Synthetic coding sequence
atgggcaagaagcacaagaagcacaagagcgacaagcacctgtacgaggagtacgtggagaagcccctgaagctggtgctgaaggtgggcggcaacgaggtgaccgagctgagcaccggcagcagcggccacgacagcagcctgttcgaggacaagaacgaccacgacaagcacaaggacagaaagagaaagaagagaaagaagggcgagaagcagatccccggcgaggagaagggcagaaagagaagaagagtgaaggaggacaagaagaagagagacagagacagagtggagaacgaggccgagaaggacctgcagtgccacgcccccgtgagactggacctgccccccgagaagcccctgaccagcagcctggccaagcaggaggaggtggagcagacccccctgcaggaggccctgaaccagctgatgagacagctgcagagaaaggaccccagcgccttcttcagcttccccgtgaccgacttcatcgcccccggctacagcatgatcatcaagcaccccatggacttcagcaccatgaaggagaagatcaagaacaacgactaccagagcatcgaggagctgaaggacaacttcaagctgatgtgcaccaacgccatgatctacaacaagcccgagaccatctactacaaggccgccaagaagctgctgcacagcggcatgaagatcctgagccaggagagaatccagagcctgaagcagagcatcgacttcatggccgacctgcagaagaccagaaagcagaaggacggcaccgacaccagccagagcggcgaggacggcggctgctggcagagagagagagaggacagcggcgacgccgaggcccacgccttcaagagccccagcaaggagaacaagaagaaggacaaggacatgctggaggacaagttcaagagcaacaacctggagagagagcaggagcagctggacagaatcgtgaaggagagcggcggcaagctgaccagaagactggtgaacagccagtgcgagttcgagagaagaaagcccgacggcaccaccaccctgggcctgctgcaccccgtggaccccatcgtgggcgagcccggctactgccccgtgagactgggcatgaccaccggcagactgcagagcggcgtgaacaccctgcagggcttcaaggaggacaagagaaacaaggtgacccccgtgctgtacctgaactacggcccctacagcagctacgccccccactacgacagcaccttcgccaacatcagcaaggacgacagcgacctgatctacagcacctacggcgaggacagcgacctgcccagcgacttcagcatccacgagttcctggccacctgccaggactacccctacgtgatggccgacagcctgctggacgtgctgaccaagggcggccacagcagaaccctgcaggagatggagatgagcctgcccgaggacgagggccacaccagaaccctggacaccgccaaggagatggagatcaccgaggtggagccccccggcagactggacagcagcacccaggacagactgatcgccctgaaggccgtgaccaacttcggcgtgcccgtggaggtgttcgacagcgaggaggccgagatcttccagaagaagctggacgagaccaccagactgctgagagagctgcaggaggcccagaacgagagactgagcaccagacccccccccaacatgatctgcctgctgggccccagctacagagagatgcacctggccgagcaggtgaccaacaacctgaaggagctggcccagcaggtgacccccggcgacatcgtgagcacctacggcgtgagaaaggccatgggcatcagcatccccagccccgtgatggagaacaacttcgtggacctgaccgaggacaccgaggagcccaagaagaccgacgtggccgagtgcggccccggcggcagctag

SEQ ID NO: 9665 - DNA, 1959 bp, Artificial Sequence
  Description of Artificial Sequence: Synthetic coding sequence
atgggcaagaagcacaagaagcacaagagcgacaagcacctgtacgaggagtacgtggagaagcccctgaagctggtgctgaaggtgggcggcaacgaggtgaccgagctgagcaccggcagcagcggccacgacagcagcctgttcgaggacaagaacgaccacgacaagcacaaggacagaaagagaaagaagagaaagaagggcgagaagcagatccccggcgaggagaagggcagaaagagaagaagagtgaaggaggacaagaagaagagagacagagacagagtggagaacgaggccgagaaggacctgcagtgccacgcccccgtgagactggacctgccccccgagaagcccctgaccagcagcctggccaagcaggaggaggtggagcagacccccctgcaggaggccctgaaccagctgatgagacagctgcagagaaaggaccccagcgccttcttcagcttccccgtgaccgacttcatcgcccccggctacagcatgatcatcaagcaccccatggacttcagcaccatgaaggagaagatcaagaacaacgactaccagagcatcgaggagctgaaggacaacttcaagctgatgtgcaccaacgccatgatctacaacaagcccgagaccatctactacaaggccgccaagaagctgctgcacagcggcatgaagatcctgagccaggagagaatccagagcctgaagcagagcatcgacttcatggccgacctgcagaagaccagaaagcagaaggacggcaccgacaccagccagagcggcgaggacggcggctgctggcagagagagagagaggacagcggcgacgccgaggcccacgccttcaagagccccagcaaggagaacaagaagaaggacaaggacatgctggaggacaagttcaagagcaacaacctggagagagagcaggagcagctggacagaatcgtgaaggagagcggcggcaagctgaccagaagactggtgaacagccagtgcgagttcgagagaagaaagcccgacggcaccaccaccctgggcctgctgcaccccgtggaccccatcgtgggcgagcccggctactgccccgtgagactgggcatgaccaccggcagactgcagagcggcgtgaacaccctgcagggcttcaaggaggacaagagaaacaaggtgacccccgtgctgtacctgaactacggcccctacagcagctacgccccccactacgacagcaccttcgccaacatcagcaaggacgacagcgacctgatctacagcacctacggcgaggacagcgacctgcccagcgacttcagcatccacgagttcctggccacctgccaggactacccctacgtgatggccgacagcctgctggacgtgctgaccaagggcggccacagcagaaccctgcaggagatggagatgagcctgcccgaggacgagggccacaccagaaccctggacaccgccaaggagatggagcagatcaccgaggtggagccccccggcagactggacagcagcacccaggacagactgatcgccctgaaggccgtgaccaacttcggcgtgcccgtggaggtgttcgacagcgaggaggccgagatcttccagaagaagctggacgagaccaccagactgctgagagagctgcaggaggcccagaacgagagactgagcaccagacccccccccaacatgatctgcctgctgggccccagctacagagagatgcacctggccgagcaggtgaccaacaacctgaaggagctggcccagcaggtgacccccggcgacatcgtgagcacctacggcgtgagaaaggccatgggcatcagcatccccagccccgtgatggagaacaacttcgtggacctgaccgaggacaccgaggagcccaagaagaccgacgtggccgagtgcggccccggcggcagctag

SEQ ID NO: 9666 - DNA, 1959 bp, Artificial Sequence; identical to SEQ ID NO: 9665
  Description of Artificial Sequence: Synthetic coding sequence

SEQ ID NO: 9667 - DNA, 1980 bp, Artificial Sequence
  Description of Artificial Sequence: Synthetic coding sequence
atggccgccgtgatcctggagagcatcttcctgaagagaagccagcagaagaagaagaccagccccctgaacttcaagaagagactgttcctgctgaccgtgcacaagctgagctactacgagtacgacttcgagagaggcagaagaggcagcaagaagggcagcatcgacgtggagaagatcacctgcgtggagaccgtggtgcccgagaagaaccccccccccgagagacagatccccagaagaggcgaggagagcagcgagatggagcagatcagcatcatcgagagattcccctaccccttccaggtggtgtacgacgagggccccctgtacgtgttcagccccaccgaggagctgagaaagagatggatccaccagctgaagaacgtgatcagatacaacagcgacctggtgcagaagtaccacccctgcttctggatcgacggccagtacctgtgctgcagccagaccgccaagaacgccatgggctgccagatcctggagaacagaaacggcagcctgaagcccggcagcagccacagaaagaccaagaagcccctgccccccacccccgaggaggaccagatcctgaagaagcccctgccccccgagcccgccgccgcccccgtgagcaccagcgagctgaagaaggtggtggccctgtacgactacatgcccatgaacgccaacgacctgcagctgagaaagggcgacgagtacttcatcctggaggagagcaacctgccctggtggagagccagagacaagaacggccaggagggctacatccccagcaactacgtgaccgaggccgaggacagcatcgagatgtacgagtggtacagcaagcacatgaccagaagccaggccgagcagctgctgaagcaggagggcaaggagggcggcttcatcgtgagagacagcagcaaggccggcaagtacaccgtgagcgtgttcgccaagagcaccggcgacccccagggcgtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcagctgggagatcgaccccaaggacctgaccttcctgaaggagctgggcaccggccagttcggcgtggtgaagtacggcaagtggagaggccagtacgacgtggccatcaagatgatcaaggagggcagcatgagcgaggacgagttcatcgaggaggccaaggtgatgatgaacctgagccacgagaagctggtgcagctgtacggcgtgtgcaccaagcagagacccatcttcatcatcaccgagtacatggccaacggctgcctgctgaactacctgagagagatgagacacagattccagacccagcagctgctggagatgtgcaaggacgtgtgcgaggccatggagtacctggagagcaagcagttcctgcacagagacctggccgccagaaactgcctggtgaacgaccagggcgtggtgaaggtgagcgacttcggcctgagcagatacgtgctggacgacgagtacaccagcagcgtgggcagcaagttccccgtgagatggagcccccccgaggtgctgatgtacagcaagttcagcagcaagagcgacatctgggccttcggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9668 - DNA, 627 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagaacccagcagctgctggagatgtgcaaggacgtgtgcgaggccatggagtacctggagagcaagcagttcctgcacagagacctggccgccagaaactgcctggtgaacgaccagggcgtggtgaaggtgagcgacttcggcctgagcagatacgtgctggacgacgagtacaccagcagcgtgggcagcaagttccccgtgagatggagcccccccgaggtgctgatgtacagcaagttcagcagcaagagcgacatctgggccttcggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9669 - DNA, 420 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9670 - DNA, 705 bp, Artificial Sequence
  Description of Artificial Sequence: Synthetic coding sequence
agacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcagctgggagatcgaccccaaggacctgaccttcctgaaggagctgggcaccggccagttcggcgtggtgaagtacggcaagtggagaggccagtacgacgtggccatcaagatgatcaaggagggcagcatgagcgaggacgagttcatcgaggaggccaaggtgatgatgtacgtgctggacgacgagtacaccagcagcgtgggcagcaagttccccgtgagatggagcccccccgaggtgctgatgtacagcaagttcagcagcaagagcgacatctgggccttcggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9671 - DNA, 225 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcatgagctggatgatgaacacccaggcccagtag

SEQ ID NO: 9672 - DNA, 1452 bp, Artificial Sequence
  Description of Artificial Sequence: Synthetic coding sequence
atggccgccgtgatcctggagagcatcttcctgaagagaagccagcagaagaagaagaccagccccctgaacttcaagaagagactgttcctgctgaccgtgcacaagctgagctactacgagtacgacttcgagagaggcagaagaggcagcaagaagggcagcatcgacgtggagaagatcacctgcgtggagaccgtggtgcccgagaagaaccccccccccgagagacagatccccagaagaggcgaggagagcagcgagatggagcagatcagcatcatcgagagattcccctaccccttccaggtggtgtacgacgagggccccctgtacgtgttcagccccaccgaggagctgagaaagagatggatccaccagctgaagaacgtgatcagatacaacagcgacctggtgcagaagtaccacccctgcttctggatcgacggccagtacctgtgctgcagccagaccgccaagaacgccatgggctgccagatcctggagaacagaaacggcagcctgaagcccggcagcagccacagaaagaccaagaagcccctgccccccacccccgaggaggaccagatcctgaagaagcccctgccccccgagcccgccgccgcccccgtgagcaccagcgagctgaagaaggtggtggccctgtacgactacatgcccatgaacgccaacgacctgcagctgagaaagggcgacgagtacttcatcctggaggagagcaacctgccctggtggagagccagagacaagaacggccaggagggctacatccccagcaactacgtgaccgaggccgaggacagcatcgagatgtacgagtggtacagcaagcacatgaccagaagccaggccgagcagctgctgaagcaggagggcaaggagggcggcttcatcgtgagagacagcagcaaggccggcaagtacaccgtgagcgtgttcgccaagagcaccggcgacccccagggcgtgatcagacactacgtggtgtgcagcaccccccagagccagtactacctggccgccagaaactgcctggtgaacgaccagggcgtggtgaaggtgagcgacttcggcctgagcagatacgtgctggacgacgagtacaccagcagcgtgggcagcaagttccccgtgagatggagcccccccgaggtgctgatgtacagcaagttcagcagcaagagcgacatctgggccttcggcgtgctgatgtgggagatctacagcctgggcaagatgccctacgagagattcaccaacagcgagaccgccgagcacatcgcccagggcctgagactgtacagaccccacctggccagcgagaaggtgtacaccatcatgtacagctgctggcacgagaaggccgacgagagacccaccttcaagatcctgctgagcaacatcctggacgtgatggacgaggagagctag

SEQ ID NO: 9673 - DNA, 519 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcagctgggagatcgaccccaaggacctgaccttcctgaaggagctgggcaccggccagttcggcgtggtgaagtacggcaagtggagaggccagtacgacgtggccatcaagatgatcaaggagggcagcatgagcgaggacgagttcatcgaggaggccaaggtgatgatgaacctgagccacgagaagctggtgcagctgtacggcgtgtgcaccaagcagagacccatcttcatcatcaccgagtacatggccaacggctgcctgccctgcaccgtggccggcatgagaaagcagatgagcgtgcccctgagcaagttcttctag

SEQ ID NO: 9674 - DNA, 594 bp, Artificial Sequence
  Description of Artificial Sequence: Synthetic coding sequence
gtgatcagacactacgtggtgtgcagcaccccccagagccagtactacctggccgagaagcacctgttcagcaccatccccgagctgatcaactaccaccagcacaacagcgccggcctgatcagcagactgaagtaccccgtgagccagcagaacaagaacgcccccagcaccgccggcctgggctacggcagctgggagatcgaccccaaggacctgaccttcctgaaggagctgggcaccggccagttcggcgtggtgaagtacggcaagtggagaggccagtacgacgtggccatcaagatgatcaaggagggcagcatgagcgaggacgagttcatcgaggaggccaaggtgatgatgaacctgagccacgagaagctggtgcagctgtacggcgtgtgcaccaagcagagacccatcttcatcatcaccgagtacatggccaacggctgcctgctgaactacctgagagagatgagacacagattccagacccagcagctgctggagatgtgcaaggacgtgtgcgaggccatggagtacctggagagcaagcagttcctgcacagagacctggtgtgccccggctag

SEQ ID NO: 9675 - DNA, 156 bp, Artificial Sequence
  Description of Artificial Sequence: Synthetic coding sequence
atcagacactacgtggtgtgcagcaccccccagagccagtactacctggccgagaagcacctgttcagcaccatccccgagctgatcaactaccaccagcacaacagcgccggcgaggacagcgccgccgccagagacgtgcagggctgcctgtag

SEQ ID NO: 9676 - DNA, 891 bp, Artificial Sequence
  Description of Artificial Sequence: Synthetic coding sequence
atgaagaacgagatcgccgccgtggtgttcttcttcaccagactggtgagaaagcacgacaagctgaagaaggaggccgtggagagattcgccgagaagctgaccctgatcctgcaggagaagtacaagaaccactggtaccccgagaagcccagcaagggccaggcctacagatgcatcagagtgaacaagttccagagagtggaccccgacgtgctgaaggcctgcgagaacagctgcatcctgtacagcgacctgggcctgcccaaggagctgaccctgtgggtggacccctgcgaggtgtgctgcagaagagacggcgtgagcccctgctggcccgactgcagccagacccccgacctggtgatcagacccccctggccccccaaggccctggactacagaagagagcccctgagacccgccagcagcttcctgatcatgtacggcgagaagaacaacgccttcatcgtggccagcttcgagaacaaggacgagaacaaggacgagatcagcagaaaggtgaccagagccctggacaaggtgaccagcgactaccacagcggcagcagcagcagcgacgaggagaccagcaaggagatggaggtgaagcccagcagcgtgaccgccgccgccagccccgtgtaccagatcagcgagctgatcttcccccccctgcccatgtggcaccccctgcccagaaagaagcccggcatgtacagaggcaacggccaccagaaccactaccccccccccgtgcccttcggctaccccaaccagggcagaaagaacaagccctacagacccatccccgtgacctgggtgcccccccccggcatgcactgcgacagaaaccactggatcaacccccacatgctggccccccactag

SEQ ID NO: 9677 - DNA, 759 bp, Artificial Sequence
  Description of Artificial Sequence: Synthetic coding sequence
atgaagaacgagatcgccgccgtggtgttcttcttcaccagactggtgagaaagcacgacaagctgaagaaggaggccgtggagagattcgccgagaagctgaccctgatcctgcaggagaagtacaagaaccactggtaccccgagaagcccagcaagggccaggcctacagatgcatcagagtgaacaagttccagagagtggaccccgacgtgctgaaggcctgcgagaacagctgcatcctgtacagcgacctgggcctgcccaaggagctgaccctgtgggtggacccctgcgaggtgtgctgcagatacggcgagaagaacaacgccttcatcgtggccagcttcgagaacaaggacgagaacaaggacgagatcagcagaaaggtgaccagagccctggacaaggtgaccagcgactaccacagcggcagcagcagcagcgacgaggagaccagcaaggagatggaggtgaagcccagcagcgtgaccgccgccgccagccccgtgtaccagatcagcgagctgatcttcccccccctgcccatgtggcaccccctgcccagaaagaagcccggcatgtacagaggcaacggccaccagaaccactaccccccccccgtgcccttcggctaccccaaccagggcagaaagaacaagccctacagacccatccccgtgacctgggtgcccccccccggcatgcactgcgacagaaaccactggatcaacccccacatgctggccccccactag

SEQ ID NO: 9678 - DNA, 141 bp, Artificial Sequence
  Description of Artificial Sequence: Synthetic coding sequence
atgaagaacgagatcgccgccgtggtgttcttcttcaccagactggtgagaaagcacgacaagctgaagaaggaggccgtggagagattcgccgagaagctgaccctgatcctgcaggagaagtacaagaaccactggtag

SEQ ID NO: 9679 - DNA, 1560 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgtggtgccccagaccaccgtgatcctgaacaacgacagacagaacgccatcgtggccaagatggaggaccccctgagcaacagagcccccgacagcctggagaacgtgatcagcaacgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgggccacctgcacatcgcccaggtgccccagggcgagcaggtgcagatcacccaggacagcgagggcaacctgcagatccaccacgtgggccaggacggccagctgctggaggccaccagaatcccctgcctgctggcccccagcgtgttcaaggccagcagcggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9680 - DNA, 1398 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9681 - DNA, 1410 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9682 - DNA, 1494 bp, Artificial Sequence
  Description of Artificial Sequence: Synthetic coding sequence
atgatgagcgagcacgacctggccgacgtggtgcagatcgccgtggaggacctgagccccgaccaccccggcaccgagctgtgggacatcgtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccagctgctggaggccaccagaatcccctgcctgctggcccccagcgtgttcaaggccagcagcggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9683 - DNA, 1560 bp, Artificial Sequence; identical to SEQ ID NO: 9679
  Description of Artificial Sequence: Synthetic coding sequence

SEQ ID NO: 9684 - DNA, 1476 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccagctgctggaggccaccagaatcccctgcctgctggcccccagcgtgttcaaggccagcagcggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9685 - DNA, 357 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaagtag

SEQ ID NO: 9686 - DNA, 87 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaactag

SEQ ID NO: 9687 - DNA, 288 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagtag

SEQ ID NO: 9688 - DNA, 372 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgtggtgtag

SEQ ID NO: 9689 - DNA, 588 bp, Artificial Sequence
  Description of Artificial Sequence: Synthetic coding sequence
atgatgagcgagcacgacctggccgacgtggtgcagatcgccgtggaggacctgagccccgaccaccccggcaccgagctgtgggacatcgtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggctag

SEQ ID NO: 9690 - DNA, 360 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgtag

SEQ ID NO: 9691 - DNA, 1401 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgggccacctgcacatcgcccaggtgccccagggcgagcaggtgcagatcacccaggacagcgagggcaacctgcagatccaccacgtgggccaggacggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9692 - DNA, 753 bp, Artificial Sequence
  Description of Artificial Sequence: Synthetic coding sequence
atgggcagccccgagcccacccagggccccagactgagccccatcctgatcccctacagcggcagaagatacaaggtgggcagagccagcggcgccctgtgccaccaggacagcctgccccccatcctggagctgggcctgaccttcctgagagccagcgccggcttcagcgtgcccaccagcagcagcttcgccctgcccgagcccctgagaagcctgtgcctgggcaacggcgagggcctgggcctgagcctgaccctgaccgtgctggcctggatcctgggcctgagcggcaccctgggcgccctggtgctgttcatggtggccaccggcatcttccaggaggccctgtggcacctgctgctgctgagcttcagcgtggaggccctgccctgcttcttcttcttccccttcttcctgctgtgcagatgcctgagagccgagctgcagatccagcagagactggacggcaccctgagcctggacctgatgagactggagagcgacggcgagaccggctgcgccgccgagagcagcgtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9693 - DNA, 1527 bp, Artificial Sequence
  Description of Artificial Sequence: Synthetic coding sequence
atgatgagcgagcacgacctggccgacgtggtgcagatcgccgtggaggacctgagccccgaccaccccgtggtgctggagaaccacgtggtgaccgacgaggacgagcccgccctgaagagacagagactggagatcaactgccaggaccccagcatcaagagcttcctgtacagcatcaaccagaccatctgcctgagactggacagcatcgaggccaagctgcaggccctggaggccacctgcaagagcctggaggagaagctggacctggtgaccaacaagcagcacagccccatccaggtgcccatggtggccggcagccccctgggcgccacccagacctgcaacaaggtgagatgcgtggtgccccagaccaccgtgatcctgaacaacgacagacagaacgccatcgtggccaagatggaggaccccctgagcaacagagcccccgacagcctggagaacgtgatcagcaacgccgtgcccggcagaagacagaacaccatcgtggtgaaggtgcccggccaggaggacagccaccacgaggacggcgagagcggcagcgaggccagcgacagcgtgagcagctgcggccaggccggcagccagagcatcggcagcaacgtgaccctgatcaccctgaacagcgaggaggactaccccaacggcacctggctgggcgacgagaacaaccccgagatgagagtgagatgcgccatcatccccagcgacatgctgcacatcagcaccaactgcagaaccgccgagaagatggccctgaccctgctggactacctgttccacagagaggtgcaggccgtgagcaacctgagcggccagggcaagcacggcaagaagcagctggaccccctgaccatctacggcatcagatgccacctgttctacaagttcggcatcaccgagagcgactggtacagaatcaagcagagcatcgacagcaagtgcagaaccgcctggagaagaaagcagagaggccagagcctggccgtgaagagcttcagcagaagaacccccaacagcagcagctactgccccagcgagcccatgatgagcacccccccccccgccagcgagctgccccagccccagccccagccccaggccctgcactacgccctggccaacgcccagcaggtgcagatccaccagatcggcgaggacggccaggtgcaggtgatcccccagggccacctgcacatcgcccaggtgccccagggcgagcaggtgcagatcacccaggacagcgagggcaacctgcagatccaccacgtgggccaggacggccaggtgctgcagggcgcccagctgatcgccgtggccagcagcgaccccgccgccgccggcgtggacggcagccccctgcagggcagcgacatccaggtgcagtacgtgcagctggcccccgtgagcgaccacaccgccggcgcccagaccgccgaggccctgcagcccaccctgcagcccgagatgcagctggagcacggcgccatccagatccagtag

SEQ ID NO: 9694 - DNA, 1476 bp, Artificial Sequence; identical to SEQ ID NO: 9684
  Description of Artificial Sequence: Synthetic coding sequence

SEQ ID NO: 9695 - DNA, 3153 bp, Artificial Sequence
  Description of Artificial Sequence: Synthetic coding sequence
atggccgccgtgaagaaggagggcggcgccctgagcgaggccatgagcctggagggcgacgagtgggagctgagcaaggagaacgtgcagcccctgagacagggcagaatcatgagcaccctgcagggcgccctggcccaggagagcgcctgcaacaacaccctgcagcagcagaagagagccttcgagtacgagatcagattctacaccggcaacgaccccctggacgtgtgggacagatacatcagctggaccgagcagaactacccccagggcggcaaggagagcaacatgagcaccctgctggagagagccgtggaggccctgcagggcgagaagagatactacagcgaccccagattcctgaacctgtggctgaagctgggcagactgtgcaacgagcccctggacatgtacagctacctgcacaaccagggcatcggcgtgagcctggcccagttctacatcagctgggccgaggagtacgaggccagagagaacttcagaaaggccgacgccatcttccaggagggcatccagcagaaggccgagcccctggagagactgcagagccagcacagacagttccaggccagagtgagcagacagaccctgctggccctggagaaggaggaggaggaggaggtgttcgagagcagcgtgccccagagaagcaccctggccgagctgaagagcaagggcaagaagaccgccagagcccccatcatcagagtgggcggcgccctgaaggcccccagccagaacagaggcctgcagaaccccttcccccagcagatgcagaacaacagcagaatcaccgtgttcgacgagaacgccgacgaggccagcaccgccgagctgagcaagcccaccgtgcagccctggatcgccccccccatgcccagagccaaggagaacgagctgcaggccggcccctggaacaccggcagaagcctggagcacagacccagaggcaacaccgccagcctgatcgccgtgcccgccgtgctgcccagcttcaccccctacgtggaggagaccgccagacagcccgtgatgaccccctgcaagatcgagcccagcatcaaccacatcctgagcaccagaaagcccggcaaggaggagggcgaccccctgcagagagtgcagagccaccagcaggccagcgaggagaagaaggagaagatgatgtactgcaaggagaagatctacgccggcgtgggcgagttcagcttcgaggagatcagagccgaggtgttcagaaagaagctgaaggagcagagagaggccgagctgctgaccagcgccgagaagagagccgagatgcagaagcagatcgaggagatggagaagaagctgaaggagatccagaccacccagcaggagagaaccggcgaccagcaggaggagaccatgcccaccaaggagaccaccaagctgcagatcgccagcgagagccagaagatccccggcatgaccctgagcagcagcgtgtgccaggtgaactgctgcgccagagagaccagcctggccgagaacatctggcaggagcagccccacagcaagggccccagcgtgcccttcagcatcttcgacgagttcctgctgagcgagaagaagaacaagagcccccccgccgacccccccagagtgctggcccagagaagacccctggccgtgctgaagaccagcgagagcatcaccagcaacgaggacgtgagccccgacgtgtgcgacgagttcaccggcatcgagcccctgagcgaggacgccatcatcaccggcttcagaaacgtgaccatctgccccaaccccgaggacacctgcgacttcgccagagccgccagattcgtgagcacccccttccacgagatcatgagcctgaaggacctgcccagcgaccccgagagactgctgcccgaggaggacctggacgtgaagaccagcgaggaccagcagaccgcctgcggcaccatctacagccagaccctgagcatcaagaagctgagccccatcatcgaggacagcagagaggccacccacagcagcggcttcagcggcagcagcgccagcgtggccagcaccagcagcatcaagtgcctgcagatccccgagaagctggagctgaccaacgagaccagcgagaaccccacccagagcccctggtgcagccagtacagaagacagctgctgaagagcctgcccgagctgagcgccagcgccgagctgtgcatcgaggacagacccatgcccaagctggagatcgagaaggagatcgagctgggcaacgaggactactgcatcaagagagagtacctgatctgcgaggactacaagctgttctgggtggcccccagaaacagcgccgagctgaccgtgatcaaggtgagcagccagcccgtgccctgggacttctacatcaacctgaagctgaaggagagactgaacgaggacttcgaccacttctgcagctgctaccagtaccaggacggctgcatcgtgtggcaccagtacatcaactgcttcaccctgcaggacctgctgcagcacagcgagtacatcacccacgagatcaccgtgctgatcatctacaacctgctgaccatcgtggagatgctgcacaaggccgagatcgtgcacggcgacctgagccccagatgcctgatcctgagaaacagaatccacgacccctacgactgcaacaagaacaaccaggccctgaagatcgtggacttcagctacagcgtggacctgagagtgcagctggacgtgttcaccctgagcggcttcagaaccgtgcagatcctggagggccagaagatcctggccaactgcagcagcccctaccaggtggacctgttcggcatcgccgacctggcccacctgctgctgttcaaggagcacctgcaggtgttctgggacggcagcttctggaagctgagccagaacatcagcgagctgaaggacggcgagctgtggaacaagttcttcgtgagaatcctgaacgccaacgacgaggccaccgtgagcgtgctgggcgagctggccgccgagatgaacggcgtgttcgacaccaccttccagagccacctgaacaaggccctgtggaaggtgggcaagctgaccagccccggcgccctgctgttccagtag

SEQ ID NO: 9696 - DNA, 3195 bp, Artificial Sequence
  Description of Artificial Sequence: Synthetic coding sequence
atggccgccgtgaagaaggagggcggcgccctgagcgaggccatgagcctggagggcgacgagtgggagctgagcaaggagaacgtgcagcccctgagacagggcagaatcatgagcaccctgcagggcgccctggcccaggagagcgcctgcaacaacaccctgcagcagcagaagagagccttcgagtacgagatcagattctacaccggcaacgaccccctggacgtgtgggacagatgggtgttcctgttccacaaggacaacagaaacatcaacagatacatcagctggaccgagcagaactacccccagggcggcaaggagagcaacatgagcaccctgctggagagagccgtggaggccctgcagggcgagaagagatactacagcgaccccagattcctgaacctgtggctgaagctgggcagactgtgcaacgagcccctggacatgtacagctacctgcacaaccagggcatcggcgtgagcctggcccagttctacatcagctgggccgaggagtacgaggccagagagaacttcagaaaggccgacgccatcttccaggagggcatccagcagaaggccgagcccctggagagactgcagagccagcacagacagttccaggccagagtgagcagacagaccctgctggccctggagaaggaggaggaggaggaggtgttcgagagcagcgtgccccagagaagcaccctggccgagctgaagagcaagggcaagaagaccgccagagcccccatcatcagagtgggcggcgccctgaaggcccccagccagaacagaggcctgcagaaccccttcccccagcagatgcagaacaacagcagaatcaccgtgttcgacgagaacgccgacgaggccagcaccgccgagctgagcaagcccaccgtgcagccctggatcgccccccccatgcccagagccaaggagaacgagctgcaggccggcccctggaacaccggcagaagcctggagcacagacccagaggcaacaccgccagcctgatcgccgtgcccgccgtgctgcccagcttcaccccctacgtggaggagaccgccagacagcccgtgatgaccccctgcaagatcgagcccagcatcaaccacatcctgagcaccagaaagcccggcaaggaggagggcgaccccctgcagagagtgcagagccaccagcaggccagcgaggagaagaaggagaagatgatgtactgcaaggagaagatctacgccggcgtgggcgagttcagcttcgaggagatcagagccgaggtgttcagaaagaagctgaaggagcagagagaggccgagctgctgaccagcgccgagaagagagccgagatgcagaagcagatcgaggagatggagaagaagctgaaggagatccagaccacccagcaggagagaaccggcgaccagcaggaggagaccatgcccaccaaggagaccaccaagctgcagatcgccagcgagagccagaagatccccggcatgaccctgagcagcagcgtgtgccaggtgaactgctgcgccagagagaccagcctggccgagaacatctggcaggagcagccccacagcaagggccccagcgtgcccttcagcatcttcgacgagttcctgctgagcgagaagaagaacaagagcccccccgccgacccccccagagtgctggcccagagaagacccctggccgtgctgaagaccagcgagagcatcaccagcaacgaggacgtgagccccgacgtgtgcgacgagttcaccggcatcgagcccctgagcgaggacgccatcatcaccggcttcagaaacgtgaccatctgccccaaccccgaggacacctgcgacttcgccagagccgccagattcgtgagcacccccttccacgagatcatgagcctgaaggacctgcccagcgaccccgagagactgctgcccgaggaggacctggacgtgaagaccagcgaggaccagcagaccgcctgcggcaccatctacagccagaccctgagcatcaagaagctgagccccatcatcgaggacagcagagaggccacccacagcagcggcttcagcggcagcagcgccagcgtggccagcaccagcagcatcaagtgcctgcagatccccgagaagctggagctgaccaacgagaccagcgagaaccccacccagagcccctggtgcagccagtacagaagacagctgctgaagagcctgcccgagctgagcgccagcgccgagctgtgcatcgaggacagacccatgcccaagctggagatcgagaaggagatcgagctgggcaacgaggactactgcatcaagagagagtacctgatctgcgaggactacaagctgttctgggtggcccccagaaacagcgccgagctgaccgtgatcaaggtgagcagccagcccgtgccctgggacttctacatcaacctgaagctgaaggagagactgaacgaggacttcgaccacttctgcagctgctaccagtaccaggacggctgcatcgtgtggcaccagtacatcaactgcttcaccctgcaggacctgctgcagcacagcgagtacatcacccacgagatcaccgtgctgatcatctacaacctgctgaccatcgtggagatgctgcacaaggccgagatcgtgcacggcgacctgagccccagatgcctgatcctgagaaacagaatccacgacccctacgactgcaacaagaacaaccaggccctgaagatcgtggacttcagctacagcgtggacctgagagtgcagctggacgtgttcaccctgagcggcttcagaaccgtgcagatcctggagggccagaagatcctggccaactgcagcagcccctaccaggtggacctgttcggcatcgccgacctggcccacctgctgctgttcaaggagcacctgcaggtgttctgggacggcagcttctggaagctgagccagaacatcagcgagctgaaggacggcgagctgtggaacaagttcttcgtgagaatcctgaacgccaacgacgaggccaccgtgagcgtgctgggcgagctggccgccgagatgaacggcgtgttcgacaccaccttccagagccacctgaacaaggccctgtggaaggtgggcaagctgaccagccccggcgccctgctgttccagtag

SEQ ID NO: 9697 - DNA, 2802 bp, Artificial Sequence
  Description of Artificial Sequence: Synthetic coding sequence
atggccgccgtgaagaaggagggcggcgccctgagcgaggccatgagcctggagggcgacgagtgggagctgagcaaggagaacgtgcagcccctgagacagggcagaatcatgagcaccctgcagggcgccctggcccaggagagcgcctgcaacaacaccctgcagcagcagaagagagccttcgagtacgagatcagattctacaccggcaacgaccccctggacgtgtgggacagatacatcagctggaccgagcagaactacccccagggcggcaaggagagcaacatgagcaccctgctggagagagccgtggaggccctgcagggcgagaacttctggaaggccgacgccatcttccaggagggcatccagcagaaggccgagcccctggagagactgcagagccagcacagacagttccaggccagagtgagcagacagaccctgctggccctggagaaggaggaggaggaggaggtgttcgagagcagcgtgccccagagaagcaccctggccgagctgaagagcaagggcaagaagaccgccagagcccccatcatcagagtgggcggcgccctgaaggcccccagccagaacagaggcctgcagaaccccttcccccagcagatgcagaacaacagcagaatcaccgtgttcgacgagaacgccgacgaggccagcaccgccgagctgagcaagcccaccgtgcagccctggatcgccccccccatgcccagagccaaggagaacgagctgcaggccggcccctggaacaccggcagaagcctggagcacagacccagaggcaacaccgccagcctgatcgccgtgcccgccgtgctgcccagcttcaccccctacgtggaggagaccgccagacagcccgtgatgaccccctgcaagatcgagcccagcatcaaccacatcctgagcaccagaaagcccggcaaggaggagggcgaccccctgcagagagtgcagagccaccagcaggccagcgaggagaagaaggagaagatgatgtactgcaaggagaagatctacgccggcgtgggcgagttcagcttcgaggagatcagagccgaggtgttcagaaagaagctgaaggagcagagagaggccgagctgctgaccagcgccgagaagagagccgagatgcagaagcagatcgaggagatggagaagaagctgaaggagatccagaccacccagcaggagagaaccggcgaccagcaggaggagaccatgcccaccaaggagaccaccaagctgcagatcgccagcgagagccagaagatccccggcatgaccctgagcagcagcgtgtgccaggtgaactgctgcgccagagagaccagcctggccgagaacatctggcaggagcagccccacagcaaggtgagcctgagcctgggccccagcgtgcccttcagcatcttcgacgagttcctgctgagcgagaagaagaacaagagcccccccgccgacccccccagagtgctggcccagagaagacccctggccgtgctgaagaccagcgagagcatcaccagcaacgaggacgtgagccccgacgtgtgcgacgagttcaccggcatcgagcccctgagcgaggacgccatcatcaccggcttcagaaacgtgaccatctgccccaaccccgaggacaccagagaggccacccacagcagcggcttcagcggcagcagcgccagcgtggccagcaccagcagcatcaagtgcctgcagatccccgagaagctggagctgaccaacgagaccagcgagaaccccacccagagcccctggtgcagccagtacagaagacagctgctgaagagcctgcccgagctgagcgccagcgccgagctgtgcatcgaggacagacccatgcccaagctggagatcgagaaggagatcgagctgggcaacgaggactactgcatcaagagagagtacctgatctgcgaggactacaagctgttctgggtggcccccagaaacagcgccgagctgaccgtgatcaaggtgagcagccagcccgtgccctgggacttctacatcaacctgaagctgaaggagagactgaacgaggacttcgaccacttctgcagctgctaccagtaccaggacggctgcatcgtgtggcaccagtacatcaactgcttcaccctgcaggacctgctgcagcacagcgagtacatcacccacgagatcaccgtgctgatcatctacaacctgctgaccatcgtggagatgctgcacaaggccgagatcgtgcacggcgacctgagccccagatgcctgatcctgagaaacagaatccacgacccctacgactgcaacaagaacaaccaggccctgaagatcgtggacttcagctacagcgtggacctgagagtgcagctggacgtgttcaccctgagcggcttcagaaccgtgcagatcctggagggccagaagatcctggccaactgcagcagcccctaccaggtggacctgttcggcatcgccgacctggcccacctgctgctgttcaaggagcacctgcaggtgttctgggacggcagcttctggaagctgagccagaacatcagcgagctgaaggacggcgagctgtggaacaagttcttcgtgagaatcctgaacgccaacgacgaggccaccgtgagcgtgctgggcgagctggccgccgagatgaacggcgtgttcgacaccaccttccagagccacctgaacaaggccctgtggaaggtgggcaagctgaccagccccggcgccctgctgttccagtag

SEQ ID NO: 9698 - DNA, 3393 bp, Artificial Sequence
  Description of Artificial Sequence: Synthetic coding sequence
atgctggagatctgcctgaagctggtgggctgcaagagcaagaagggcctgagcagcagcagcagctgctacctggaggaggccctgcagagacccgtggccagcgacttcgagccccagggcctgagcgaggccgccagatggaacagcaaggagaacctgctggccggccccagcgagaacgaccccaacctgttcgtggccctgtacgacttcgtggccagcggcgacaacaccctgagcatcaccaagggcgagaagctgagagtgctgggctacaaccacaacggcgagtggtgcgaggcccagaccaagaacggccagggctgggtgcccagcaactacatcacccccgtgaacagcctggagaagcacagctggtaccacggccccgtgagcagaaacgccgccgagtacctgctgagcagcggcatcaacggcagcttcctggtgagagagagcgagagcagccccggccagagaagcatcagcctgagatacgagggcagagtgtaccactacagaatcaacaccgccagcgacggcaagctgtacgtgagcagcgagagcagattcaacaccctggccgagctggtgcaccaccacagcaccgtggccgacggcctgatcaccaccctgcactaccccgcccccaagagaaacaagcccaccgtgtacggcgtgagccccaactacgacaagtgggagatggagagaaccgacatcaccatgaagcacaagctgggcggcggccagtacggcgaggtgtacgagggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccagagagccccccttctacatcatcaccgagttcatgacctacggcaacctgctggactacctgagagagtgcaacagacaggaggtgaacgccgtggtgctgctgtacatggccacccagatcagcagcgccatggagtacctggagaagaagaacttcatccacagagacctggccgccagaaactgcctggtgggcgagaaccacctggtgaaggtggccgacttcggcctgagcagactgatgaccggcgacacctacaccgcccacgccggcgccaagttccccatcaagtggaccgcccccgagagcctggcctacaacaagttcagcatcaagagcgacgtgtgggccttcggcgtgctgctgtgggagatcgccacctacggcatgagcccctaccccggcatcgacctgagccaggtgtacgagctgctggagaaggactacagaatggagagacccgagggctgccccgagaaggtgtacgagctgatgagagcctgctggcagtggaaccccagcgacagacccagcttcgccgagatccaccaggccttcgagaccatgttccaggagagcagcatcagcgacgaggtggagaaggagctgggcaagcagggcgtgagaggcgccgtgagcaccctgctgcaggcccccgagctgcccaccaagaccagaaccagcagaagagccgccgagcacagagacaccaccgacgtgcccgagatgccccacagcaagggccagggcgagagcgaccccctggaccacgagcccgccgtgagccccctgctgcccagaaaggagagaggcccccccgagggcggcctgaacgaggacgagagactgctgcccaaggacaagaagaccaacctgttcagcgccctgatcaagaagaagaagaagaccgcccccaccccccccaagagaagcagcagcttcagagagatggacggccagcccgagagaagaggcgccggcgaggaggagggcagagacatcagcaacggcgccctggccttcacccccctggacaccgccgaccccgccaagagccccaagcccagcaacggcgccggcgtgcccaacggcgccctgagagagagcggcggcagcggcttcagaagcccccacctgtggaagaagagcagcaccctgaccagcagcagactggccaccggcgaggaggagggcggcggcagcagcagcaagagattcctgagaagctgcagcgccagctgcgtgccccacggcgccaaggacaccgagtggagaagcgtgaccctgcccagagacctgcagagcaccggcagacagttcgacagcagcaccttcggcggccacaagagcgagaagcccgccctgcccagaaagagagccggcgagaacagaagcgaccaggtgaccagaggcaccgtgacccccccccccagactggtgaagaagaacgaggaggccgccgacgaggtgttcaaggacatcatggagagcagccccggcagcagcccccccaacctgacccccaagcccctgagaagacaggtgaccgtggcccccgccagcggcctgccccacaaggaggaggccggcaagggcagcgccctgggcacccccgccgccgccgagcccgtgacccccaccagcaaggccggcagcggcgcccccggcggcaccagcaagggccccgccgaggagagcagagtgagaagacacaagcacagcagcgagagccccggcagagacaagggcaagctgagcagactgaagcccgcccccccccccccccccgccgccagcgccggcaaggccggcggcaagcccagccagagccccagccaggaggccgccggcgaggccgtgctgggcgccaagaccaaggccaccagcctggtggacgccgtgaacagcgacgccgccaagcccagccagcccggcgagggcctgaagaagcccgtgctgcccgccacccccaagccccagagcgccaagcccagcggcacccccatcagccccgcccccgtgcccagcaccctgcccagcgccagcagcgccctggccggcgaccagcccagcagcaccgccttcatccccctgatcagcaccagagtgagcctgagaaagaccagacagccccccgagagaatcgccagcggcgccatcaccaagggcgtggtgctggacagcaccgaggccctgtgcctggccatcagcagaaacagcgagcagatggccagccacagcgccgtgctggaggccggcaagaacctgtacaccttctgcgtgagctacgtggacagcatccagcagatgagaaacaagttcgccttcagagaggccatcaacaagctggagaacaacctgagagagctgcagatctgccccgccaccgccggcagcggccccgccgccacccaggacttcagcaagctgctgagcagcgtgaaggagatcagcgacatcgtgcagagatag

SEQ ID NO: 9699 - DNA, 3450 bp, Artificial Sequence
  Description of Artificial Sequence: Synthetic coding sequence
atgggccagcagcccggcaaggtgctgggcgaccagagaagacccagcctgcccgccctgcacttcatcaagggcgccggcaagaaggagagcagcagacacggcggcccccactgcaacgtgttcgtggagcacgaggccctgcagagacccgtggccagcgacttcgagccccagggcctgagcgaggccgccagatggaacagcaaggagaacctgctggccggccccagcgagaacgaccccaacctgttcgtggccctgtacgacttcgtggccagcggcgacaacaccctgagcatcaccaagggcgagaagctgagagtgctgggctacaaccacaacggcgagtggtgcgaggcccagaccaagaacggccagggctgggtgcccagcaactacatcacccccgtgaacagcctggagaagcacagctggtaccacggccccgtgagcagaaacgccgccgagtacctgctgagcagcggcatcaacggcagcttcctggtgagagagagcgagagcagccccggccagagaagcatcagcctgagatacgagggcagagtgtaccactacagaatcaacaccgccagcgacggcaagctgtacgtgagcagcgagagcagattcaacaccctggccgagctggtgcaccaccacagcaccgtggccgacggcctgatcaccaccctgcactaccccgcccccaagagaaacaagcccaccgtgtacggcgtgagccccaactacgacaagtgggagatggagagaaccgacatcaccatgaagcacaagctgggcggcggccagtacggcgaggtgtacgagggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccagagagccccccttctacatcatcaccgagttcatgacctacggcaacctgctggactacctgagagagtgcaacagacaggaggtgaacgccgtggtgctgctgtacatggccacccagatcagcagcgccatggagtacctggagaagaagaacttcatccacagagacctggccgccagaaactgcctggtgggcgagaaccacctggtgaaggtggccgacttcggcctgagcagactgatgaccggcgacacctacaccgcccacgccggcgccaagttccccatcaagtggaccgcccccgagagcctggcctacaacaagttcagcatcaagagcgacgtgtgggccttcggcgtgctgctgtgggagatcgccacctacggcatgagcccctaccccggcatcgacctgagccaggtgtacgagctgctggagaaggactacagaatggagagacccgagggctgccccgagaaggtgtacgagctgatgagagcctgctggcagtggaaccccagcgacagacccagcttcgccgagatccaccaggccttcgagaccatgttccaggagagcagcatcagcgacgaggtggagaaggagctgggcaagcagggcgtgagaggcgccgtgagcaccctgctgcaggcccccgagctgcccaccaagaccagaaccagcagaagagccgccgagcacagagacaccaccgacgtgcccgagatgccccacagcaagggccagggcgagagcgaccccctggaccacgagcccgccgtgagccccctgctgcccagaaaggagagaggcccccccgagggcggcctgaacgaggacgagagactgctgcccaaggacaagaagaccaacctgttcagcgccctgatcaagaagaagaagaagaccgcccccaccccccccaagagaagcagcagcttcagagagatggacggccagcccgagagaagaggcgccggcgaggaggagggcagagacatcagcaacggcgccctggccttcacccccctggacaccgccgaccccgccaagagccccaagcccagcaacggcgccggcgtgcccaacggcgccctgagagagagcggcggcagcggcttcagaagcccccacctgtggaagaagagcagcaccctgaccagcagcagactggccaccggcgaggaggagggcggcggcagcagcagcaagagattcctgagaagctgcagcgccagctgcgtgccccacggcgccaaggacaccgagtggagaagcgtgaccctgcccagagacctgcagagcaccggcagacagttcgacagcagcaccttcggcggccacaagagcgagaagcccgccctgcccagaaagagagccggcgagaacagaagcgaccaggtgaccagaggcaccgtgacccccccccccagactggtgaagaagaacgaggaggccgccgacgaggtgttcaaggacatcatggagagcagccccggcagcagcccccccaacctgacccccaagcccctgagaagacaggtgaccgtggcccccgccagcggcctgccccacaaggaggaggccggcaagggcagcgccctgggcacccccgccgccgccgagcccgtgacccccaccagcaaggccggcagcggcgcccccggcggcaccagcaagggccccgccgaggagagcagagtgagaagacacaagcacagcagcgagagccccggcagagacaagggcaagctgagcagactgaagcccgcccccccccccccccccgccgccagcgccggcaaggccggcggcaagcccagccagagccccagccaggaggccgccggcgaggccgtgctgggcgccaagaccaaggccaccagcctggtggacgccgtgaacagcgacgccgccaagcccagccagcccggcgagggcctgaagaagcccgtgctgcccgccacccccaagccccagagcgccaagcccagcggcacccccatcagccccgcccccgtgcccagcaccctgcccagcgccagcagcgccctggccggcgaccagcccagcagcaccgccttcatccccctgatcagcaccagagtgagcctgagaaagaccagacagccccccgagagaatcgccagcggcgccatcaccaagggcgtggtgctggacagcaccgaggccctgtgcctggccatcagcagaaacagcgagcagatggccagccacagcgccgtgctggaggccggcaagaacctgtacaccttctgcgtgagctacgtggacagcatccagcagatgagaaacaagttcgccttcagagaggccatcaacaagctggagaacaacctgagagagctgcagatctgccccgccaccgccggcagcggccccgccgccacccaggacttcagcaagctgctgagcagcgtgaaggagatcagcgacatcgtgcagagatag

SEQ ID NO: 9700 - DNA, 195 bp, Artificial Sequence
  Description of Artificial Sequence: Synthetic coding sequence
atgggccagcagcccggcaaggtgctgggcgaccagagaagacccagcctgcccgccctgcacttcatcaagggcgccggcaagaaggagagcagcagacacggcggcccccactgcaacgtgttcgtggagcaggccctgcagagacccgtggccagcgacttcgagccccagggcctgagcgaggccgcctag

SEQ ID NO: 9701 - DNA, 486 bp, Artificial Sequence
  Description of Artificial Sequence: Synthetic coding sequence
ggcagacccggcagaagcagagccagaggcggcggcgagggcggctggagaggcggcggcagagccggcagagccggccccgagcccggccccagagccggcagaggcgtgcccgcccccgactgctggagaggcaagatgctggagatctgcctgaagctggtgggctgcaagagcaagaagggcctgagcagcagcagcagctgctacctggaggaggccctgcagagacccgtggccagcgacttcgagccccagggcctgagcgaggccgccagatggaacagcaaggagaacctgctggccggccccagcgagaacgaccccaacctgttcgtggccctgtacgacttcgtggccagcggcgacaacaccctgagcatcaccaagggcgagaagctgagagtgctgggctacaaccacaacggcgagtggtgcgaggcccagaccaagaacggccagggctgggtgcccagcaactactag

SEQ ID NO: 9702 - DNA, 2838 bp, Artificial Sequence
  Description of Artificial Sequence: Synthetic coding sequence
ctgagactgctgagagagcccctgcagcaccccggcagagtgggcagcagcagcttcaacggcggcagaagagcccaccaccacgcccccctgagcagccccaaggcccagcaggcccactgcctgtggtgcgtgccccagctgagacaggtgggcgacggcacccacggccaccaccacgaggcccagggcggcggccagtacggcgaggtgtacgagggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccagagagccccccttctacatcatcaccgagttcatgacctacggcaacctgctggactacctgagagagtgcaacagacaggaggtgaacgccgtggtgctgctgtacatggccacccagatcagcagcgccatggagtacctggagaagaagaacttcatccacagagacctggccgccagaaactgcctggtgggcgagaaccacctggtgaaggtggccgacttcggcctgagcagactgatgaccggcgacacctacaccgcccacgccggcgccaagttccccatcaagtggaccgcccccgagagcctggcctacaacaagttcagcatcaagagcgacgtgtgggccttcggcgtgctgctgtgggagatcgccacctacggcatgagcccctaccccggcatcgacctgagccaggtgtacgagctgctggagaaggactacagaatggagagacccgagggctgccccgagaaggtgtacgagctgatgagagcctgctggcagtggaaccccagcgacagacccagcttcgccgagatccaccaggccttcgagaccatgttccaggagagcagcatcagcgacgaggtggagaaggagctgggcaagcagggcgtgagaggcgccgtgagcaccctgctgcaggcccccgagctgcccaccaagaccagaaccagcagaagagccgccgagcacagagacaccaccgacgtgcccgagatgccccacagcaagggccagggcgagagcgaccccctggaccacgagcccgccgtgagccccctgctgcccagaaaggagagaggcccccccgagggcggcctgaacgaggacgagagactgctgcccaaggacaagaagaccaacctgttcagcgccctgatcaagaagaagaagaagaccgcccccaccccccccaagagaagcagcagcttcagagagatggacggccagcccgagagaagaggcgccggcgaggaggagggcagagacatcagcaacggcgccctggccttcacccccctggacaccgccgaccccgccaagagccccaagcccagcaacggcgccggcgtgcccaacggcgccctgagagagagcggcggcagcggcttcagaagcccccacctgtggaagaagagcagcaccctgaccagcagcagactggccaccggcgaggaggagggcggcggcagcagcagcaagagattcctgagaagctgcagcgccagctgcgtgccccacggcgccaaggacaccgagtggagaagcgtgaccctgcccagagacctgcagagcaccggcagacagttcgacagcagcaccttcggcggccacaagagcgagaagcccgccctgcccagaaagagagccggcgagaacagaagcgaccaggtgaccagaggcaccgtgacccccccccccagactggtgaagaagaacgaggaggccgccgacgaggtgttcaaggacatcatggagagcagccccggcagcagcccccccaacctgacccccaagcccctgagaagacaggtgaccgtggcccccgccagcggcctgccccacaaggaggaggccggcaagggcagcgccctgggcacccccgccgccgccgagcccgtgacccccaccagcaaggccggcagcggcgcccccggcggcaccagcaagggccccgccgaggagagcagagtgagaagacacaagcacagcagcgagagccccggcagagacaagggcaagctgagcagactgaagcccgcccccccccccccccccgccgccagcgccggcaaggccggcggcaagcccagccagagccccagccaggaggccgccggcgaggccgtgctgggcgccaagaccaaggccaccagcctggtggacgccgtgaacagcgacgccgccaagcccagccagcccggcgagggcctgaagaagcccgtgctgcccgccacccccaagccccagagcgccaagcccagcggcacccccatcagccccgcccccgtgcccagcaccctgcccagcgccagcagcgccctggccggcgaccagcccagcagcaccgccttcatccccctgatcagcaccagagtgagcctgagaaagaccagacagccccccgagagaatcgccagcggcgccatcaccaagggcgtggtgctggacagcaccgaggccctgtgcctggccatcagcagaaacagcgagcagatggccagccacagcgccgtgctggaggccggcaagaacctgtacaccttctgcgtgagctacgtggacagcatccagcagatgagaaacaagttcgccttcagagaggccatcaacaagctggagaacaacctgagagagctgcagatctgccccgccaccgccggcagcggccccgccgccacccaggacttcagcaagctgctgagcagcgtgaaggagatcagcgacatcgtgcagagatag

SEQ ID NO: 9703 - DNA, 2649 bp, Artificial Sequence
  Description of Artificial Sequence: Synthetic coding sequence
atgggcccctggagcagaagcctgagcgccctgctgctgctgctgcaggtgagcagctggctgtgccaggagcccgagccctgccaccccggcttcgacgccgagagctacaccttcaccgtgcccagaagacacctggagagaggcagagtgctgggcagagtgaacttcgaggactgcaccggcagacagagaaccgcctacttcagcctggacaccagattcaaggtgggcaccgacggcgtgatcaccgtgaagagacccctgagattccacaacccccagatccacttcctggtgtacgcctgggacagcacctacagaaagttcagcaccaaggtgaccctgaacaccgtgggccaccaccacagaccccccccccaccaggccagcgtgagcggcatccaggccgagctgctgaccttccccaacagcagccccggcctgagaagacagaagagagactgggtgatcccccccatcagctgccccgagaacgagaagggccccttccccaagaacctggtgcagatcaagagcaacaaggacaaggagggcaaggtgttctacagcatcaccggccagggcgccgacaccccccccgtgggcgtgttcatcatcgagagagagaccggctggctgaaggtgaccgagcccctggacagagagagaatcgccacctacaccctgttcagccacgccgtgagcagcaacggcaacgccgtggaggaccccatggagatcctgatcaccgtgaccgaccagaacgacaacaagcccgagttcacccaggaggtgttcaagggcagcgtgatggagggcgccctgcccggcaccagcgtgatggaggtgaccgccaccgacgccgacgacgacgtgaacacctacaacgccgccatcgcctacaccatcctgagccaggaccccgagctgcccgacaagaacatgttcaccatcaacagaaacaccggcgtgatcagcgtggtgaccaccggcctggacagagagagcttccccacctacaccctggtggtgcaggccgccgacctgcagggcgagggcctgagcaccaccgccaccgccgtgatcaccgtgaccgacaccaacgacaacccccccatcttcaaccccaccacctacaagggccaggtgcccgagaacgaggccaacgtggtgatcaccaccctgaaggtgaccgacgccgacgcccccaacacccccgcctgggaggccgtgtacaccatcctgaacgacgacggcggccagttcgtggtgaccaccaaccccgtgaacaacgacggcatcctgaagaccgccaagggcctggacttcgaggccaagcagcagtacatcctgcacgtggccgtgaccaacgtggtgcccttcgaggtgagcctgaccaccagcaccgccaccgtgaccgtggacgtgctggacgtgaacgaggcccccatcttcgtgccccccgagaagagagtggaggtgagcgaggacttcggcgtgggccaggagatcaccagctacaccgcccaggagcccgacaccttcatggagcagaagatcacctacagaatctggagagacaccgccaactggctggagatcaaccccgacaccggcgccatcagcaccagagccgagctggacagagaggacttcgagcacgtgaagaacagcacctacaccgccctgatcatcgccaccgacaacggcagccccgtggccaccggcaccggcaccctgctgctgatcctgagcgacgtgaacgacaacgcccccatccccgagcccagaaccatcttcttctgcgagagaaaccccaagccccaggtgatcaacatcatcgacgccgacctgccccccaacaccagccccttcaccgccgagctgacccacggcgccagcgccaactggaccatccagtacaacgaccccacccaggagagcatcatcctgaagcccaagatggccctggaggtgggcgactacaagatcaacctgaagctgatggacaaccagaacaaggaccaggtgaccaccctggaggtgagcgtgtgcgactgcgagggcgccgccggcgtgtgcagaaaggcccagcccgtggaggccggcctgcagatccccgccatcctgggcatcctgggcggcatcctggccctgctgatcctgatcctgctgctgctgctgttcctgagaagaagagccgtggtgaaggagcccctgctgccccccgaggacgacaccagagacaacgtgtactactacgacgaggagggcggcggcgaggaggaccaggacttcgacctgagccagctgcacagaggcctggacgccagacccgaggtgaccagaaacgacgtggcccccaccctgatgagcgtgcccagatacctgcccagacccgccaaccccgacgagatcggcaacttcatcgacgagaacctgaaggccgccgacaccgaccccaccgcccccccctacgacagcctgctggtgttcgactacgagggcagcggcagcgaggccgccagcctgagcagcctgaacagcagcgagagcgacaaggaccaggactacgactacctgaacgagtggggcaacagattcaagaagctggccgacatgtacggcggcggcgaggacgactag

SEQ ID NO: 9704 - DNA, 1944 bp, Artificial Sequence
  Description of Artificial Sequence: Synthetic coding sequence
atgggcccctggagcagaagcctgagcgccctgctgctgctgctgcaggtgagcagctggctgtgccaggagcccgagccctgccaccccggcttcgacgccgagagctacaccttcaccgtgcccagaagacacctggagagaggcagagtgctgggcagagtgaacttcgaggactgcaccggcagacagagaaccgcctacttcagcctggacaccagattcaaggtgggcaccgacggcgtgatcaccgtgaagagacccctgagattccacaacccccagatccacttcctggtgtacgcctgggacagcacctacagaaagttcagcaccaaggtgaccctgaacaccgtgggccaccaccacagaccccccccccaccaggccagcgtgagcggcatccaggccgagctgctgaccttccccaacagcagccccggcctgagaagacagaagagagactgggtgatcccccccatcagctgccccgagaacgagaagggccccttccccaagaacctggtgcagatcaagagcaacaaggacaaggagggcaaggtgttctacagcatcaccggccagggcgccgacaccccccccgtgggcgtgttcatcatcgagagagagaccggctggctgaaggtgaccgagcccctggacagagagagaatcgccacctacaccctgttcagccacgccgtgagcagcaacggcaacgccgtggaggaccccatggagatcctgatcaccgtgaccgaccagaacgacaacaagcccgagttcacccaggaggtgttcaagggcagcgtgatggagggcgccctgcccggcaccagcgtgatggaggtgaccgccaccgacgccgacgacgacgtgaacacctacaacgccgccatcgcctacaccatcctgagccaggaccccgagctgcccgacaagaacatgttcaccatcaacagaaacaccggcgtgatcagcgtggtgaccaccggcctggacagagagagcttccccacctacaccctggtggtgcaggccgccgacctgcagggcgagggcctgagcaccaccgccaccgccgtgatcaccgtgaccgacaccaacgacaacccccccatcttcaaccccaccacctacaagggccaggtgcccgagaacgaggccaacgtggtgatcaccaccctgaaggtgaccgacgccgacgcccccaacacccccgcctgggaggccgtgtacaccatcctgaacgacgacggcggccagttcgtggtgaccaccaaccccgtgaacaacgacggcatcctgaagaccgccaagggcctggacttcgaggccaagcagcagtacatcctgcacgtggccgtgaccaacgtggtgcccttcgaggtgagcctgaccaccagcaccgccaccgtgaccgtggacgtgctggacgtgaacgaggcccccatcttcgtgccccccgagaagagagtggaggtgagcgaggacttcggcgtgggccaggagatcaccagctacaccgcccaggagcccgacaccttcatggagcagaagatcacctacagaatctggagagacaccgccaactggctggagatcaaccccgacaccggcgccatcagcaccagagccgagctggacagagaggacttcgagcacgtgaagaacagcacctacaccgccctgatcatcgccaccgacaacggcagccccgtggccaccggcaccggcaccctgctgctgatcctgagcgacgtgaacgacaacgcccccatccccgagcccagaaccatcttcttctgcgagagaaaccccaagccccaggtgatcaacatcatcgacgccgacctgccccccaacctggccagccagagcatcggcatcaccgacatgagccactgcacctgccccgccccccagctgcccgccatcttctag

SEQ ID NO: 9705 - DNA, 2703 bp, Artificial Sequence
  Description of Artificial Sequence: Synthetic coding sequence
atgggcccctggagcagaagcctgagcgccctgctgctgctgctgcaggtgagcagctggctgtgccaggagcccgagccctgccaccccggcttcgacgccgagagctacaccttcaccgtgcccagaagacacctggagagaggcagagtgctgggcagagtgaacttcgaggactgcaccggcagacagagaaccgcctacttcagcctggacaccagattcaaggtgggcaccgacggcgtgatcaccgtgaagagacccctgagattccacaacccccagatccacttcctggtgtacgcctgggacagcacctacagaaagttcagcaccaaggtgaccctgaacaccgtgggccaccaccacagaccccccccccaccaggccagcgtgagcggcatccaggccgagctgctgaccttccccaacagcagccccggcctgagaagacagaagagagactgggtgatcccccccatcagctgccccgagaacgagaagggccccttccccaagaacctggtgcagatcaagagcaacaaggacaaggagggcaaggtgttctacagcatcaccggccagggcgccgacaccccccccgtgggcgtgttcatcatcgagagagagaccggctggctgaaggtgaccgagcccctggacagagagagaatcgccacctacaccctgttcagccacgccgtgagcagcaacggcaacgccgtggaggaccccatggagatcctgatcaccgtgaccgaccagaacgacaacaagcccgagttcacccaggaggtgttcaagggcagcgtgatggagggcgccctgcccggcaccagcgtgatggaggtgaccgccaccgacgccgacgacgacgtgaacacctacaacgccgccatcgcctacaccatcctgagccaggaccccgagctgcccgacaagaacatgttcaccatcaacagaaacaccggcgtgatcagcgtggtgaccaccggcctggacagagagagcttccccacctacaccctggtggtgcaggccgccgacctgcagggcgagggcctgagcaccaccgccaccgccgtgatcaccgtgaccgacaccaacgacaacccccccatcttcaaccccaccacctacaagggccaggtgcccgagaacgaggccaacgtggtgatcaccaccctgaaggtgaccgacgccgacgcccccaacacccccgcctgggaggccgtgtacaccatcctgaacgacgacggcggccagttcgtggtgaccaccaaccccgtgaacaacgacggcatcctgaagaccgccaagctggccagatgcagaaactggcacccccacagctgcagctacccctgccccctgggcctggacttcgaggccaagcagcagtacatcctgcacgtggccgtgaccaacgtggtgcccttcgaggtgagcctgaccaccagcaccgccaccgtgaccgtggacgtgctggacgtgaacgaggcccccatcttcgtgccccccgagaagagagtggaggtgagcgaggacttcggcgtgggccaggagatcaccagctacaccgcccaggagcccgacaccttcatggagcagaagatcacctacagaatctggagagacaccgccaactggctggagatcaaccccgacaccggcgccatcagcaccagagccgagctggacagagaggacttcgagcacgtgaagaacagcacctacaccgccctgatcatcgccaccgacaacggcagccccgtggccaccggcaccggcaccctgctgctgatcctgagcgacgtgaacgacaacgcccccatccccgagcccagaaccatcttcttctgcgagagaaaccccaagccccaggtgatcaacatcatcgacgccgacctgccccccaacaccagccccttcaccgccgagctgacccacggcgccagcgccaactggaccatccagtacaacgaccccacccaggagagcatcatcctgaagcccaagatggccctggaggtgggcgactacaagatcaacctgaagctgatggacaaccagaacaaggaccaggtgaccaccctggaggtgagcgtgtgcgactgcgagggcgccgccggcgtgtgcagaaaggcccagcccgtggaggccggcctgcagatccccgccatcctgggcatcctgggcggcatcctggccctgctgatcctgatcctgctgctgctgctgttcctgagaagaagagccgtggtgaaggagcccctgctgccccccgaggacgacaccagagacaacgtgtactactacgacgaggagggcggcggcgaggaggaccaggacttcgacctgagccagctgcacagaggcctggacgccagacccgaggtgaccagaaacgacgtggcccccaccctgatgagcgtgcccagatacctgcccagacccgccaaccccgacgagatcggcaacttcatcgacgagaacctgaaggccgccgacaccgaccccaccgcccccccctacgacagcctgctggtgttcgactacgagggcagcggcagcgaggccgccagcctgagcagcctgaacagcagcgagagcgacaaggaccaggactacgactacctgaacgagtggggcaacagattcaagaagctggccgacatgtacggcggcggcgaggacgactag

SEQ ID NO: 9706 - DNA, 2466 bp, Artificial Sequence
  Description of Artificial Sequence: Synthetic coding sequence
atgggcccctggagcagaagcctgagcgccctgctgctgctgctgcaggtgagcagctggctgtgccaggagcccgagccctgccaccccggcttcgacgccgagagctacaccttcaccgtgcccagaagacacctggagagaggcagagtgctgggcagagtgaacttcgaggactgcaccggcagacagagaaccgcctacttcagcctggacaccagattcaaggtgggcaccgacggcgtgatcaccgtgaagagacccctgagattccacaacccccagatccacttcctggtgtacgcctgggacagcacctacagaaagttcagcaccaaggtgaccctgaacaccgtgggccaccaccacagaccccccccccaccaggccagcgtgagcggcatccaggccgagctgctgaccttccccaacagcagccccggcctgagaagacagaagagagactgggtgatcccccccatcagctgccccgagaacgagaagggccccttccccaagaacctggtgcagatcaagagcaacaaggacaaggagggcaaggtgttctacagcatcaccggccagggcgccgacaccccccccgtgggcgtgttcatcatcgagagagagaccggctggctgaaggtgaccgagcccctggacagagagagaatcgccacctacaccctgttcagccacgccgtgagcagcaacggcaacgccgtggaggaccccatggagatcctgatcaccgtgaccgaccagaacgacaacaagcccgagttcacccaggaggtgttcaagggcagcgtgatggagggcgccctgcccggcaccagcgtgatggaggtgaccgccaccgacgccgacgacgacgtgaacacctacaacgccgccatcgcctacaccatcctgagccaggaccccgagctgcccgacaagaacatgttcaccatcaacagaaacaccggcgtgatcagcgtggtgaccaccggcctggacagagagagcttccccacctacaccctggtggtgcaggccgccgacctgcagggcgagggcctgagcaccaccgccaccgccgtgatcaccgtgaccgacaccaacgacaacccccccatcttcaaccccaccaccggcctggacttcgaggccaagcagcagtacatcctgcacgtggccgtgaccaacgtggtgcccttcgaggtgagcctgaccaccagcaccgccaccgtgaccgtggacgtgctggacgtgaacgaggcccccatcttcgtgccccccgagaagagagtggaggtgagcgaggacttcggcgtgggccaggagatcaccagctacaccgcccaggagcccgacaccttcatggagcagaagatcacctacagaatctggagagacaccgccaactggctggagatcaaccccgacaccggcgccatcagcaccagagccgagctggacagagaggacttcgagcacgtgaagaacagcacctacaccgccctgatcatcgccaccgacaacggcagccccgtggccaccggcaccggcaccctgctgctgatcctgagcgacgtgaacgacaacgcccccatccccgagcccagaaccatcttcttctgcgagagaaaccccaagccccaggtgatcaacatcatcgacgccgacctgccccccaacaccagccccttcaccgccgagctgacccacggcgccagcgccaactggaccatccagtacaacgaccccacccaggagagcatcatcctgaagcccaagatggccctggaggtgggcgactacaagatcaacctgaagctgatggacaaccagaacaaggaccaggtgaccaccctggaggtgagcgtgtgcgactgcgagggcgccgccggcgtgtgcagaaaggcccagcccgtggaggccggcctgcagatccccgccatcctgggcatcctgggcggcatcctggccctgctgatcctgatcctgctgctgctgctgttcctgagaagaagagccgtggtgaaggagcccctgctgccccccgaggacgacaccagagacaacgtgtactactacgacgaggagggcggcggcgaggaggaccaggacttcgacctgagccagctgcacagaggcctggacgccagacccgaggtgaccagaaacgacgtggcccccaccctgatgagcgtgcccagatacctgcccagacccgccaaccccgacgagatcggcaacttcatcgacgagaacctgaaggccgccgacaccgaccccaccgcccccccctacgacagcctgctggtgttcgactacgagggcagcggcagcgaggccgccagcctgagcagcctgaacagcagcgagagcgacaaggaccaggactacgactacctgaacgagtggggcaacagattcaagaagctggccgacatgtacggcggcggcgaggacgactag

SEQ ID NO: 9707 - DNA, 2391 bp, Artificial Sequence
  Description of Artificial Sequence: Synthetic coding sequence
atgaaggagaactactgcctgcaggccgccctggtgtgcctgggcatgctgtgccacagccacgccttcgcccccgagagaagaggccacctgagacccagcttccacggccaccacgagaagggcaaggagggccaggtgctgcagagaagcaagagaggctgggtgtggaaccagttcttcgtgatcgaggagtacaccggccccgaccccgtgctggtgggcagactgcacagcgacatcgacagcggcgacggcaacatcaagtacatcctgagcggcgagggcgccggcaccatcttcgtgatcgacgacaagagcggcaacatccacgccaccaagaccctggacagagaggagagagcccagtacaccctgatggcccaggccgtggacagagacaccaacagacccctggagccccccagcgagttcatcgtgaaggtgcaggacatcaacgacaacccccccgagttcctgcacgagacctaccacgccaacgtgcccgagagaagcaacgtgggcaccagcgtgatccaggtgaccgccagcgacgccgacgaccccacctacggcaacagcgccaagctggtgtacagcatcctggagggccagccctacttcagcgtggaggcccagaccggcatcatcagaaccgccctgcccaacatggacagagaggccaaggaggagtaccacgtggtgatccaggccaaggacatgggcggccacatgggcggcctgagcggcaccaccaaggtgaccatcaccctgaccgacgtgaacgacaacccccccaagttcccccagagcgtgtaccagatgagcgtgagcgaggccgccgtgcccggcgaggaggtgggcagagtgaaggccaaggaccccgacatcggcgagaacggcctggtgacctacaacatcgtggacggcgacggcatggagagcttcgagatcaccaccgactacgagacccaggagggcgtgatcaagctgaagaagcccgtggacttcgagaccaagagagcctacagcctgaaggtggaggccgccaacgtgcacatcgaccccaagttcatcagcaacggccccttcaaggacaccgtgaccgtgaagatcagcgtggaggacgccgacgagccccccatgttcctggcccccagctacatccacgaggtgcaggagaacgccgccgccggcaccgtggtgggcagagtgcacgccaaggaccccgacgccgccaacagccccatcagatacagcatcgacagacacaccgacctggacagattcttcaccatcaaccccgaggacggcttcatcaagaccaccaagcccctggacagagaggagaccgcctggctgaacatcaccgtgttcgccgccgagatccacaacagacaccaggaggccaaggtgcccgtggccatcagagtgctggacgtgaacgacaacgcccccaagttcgccgccccctacgagggcttcatctgcgagagcgaccagaccaagcccctgagcaaccagcccatcgtgaccatcagcgccgacgacaaggacgacaccgccaacggccccagattcatcttcagcctgccccccgagatcatccacaaccccaacttcaccgtgagagacaacagagacaacaccgccggcgtgtacgccagaagaggcggcttcagcagacagaagcaggacctgtacctgctgcccatcgtgatcagcgacggcggcatcccccccatgagcagcaccaacaccctgaccatcaaggtgtgcggctgcgacgtgaacggcgccctgctgagctgcaacgccgaggcctacatcctgaacgccggcctgagcaccggcgccctgatcgccatcctggcctgcatcgtgatcctgctggtgatcgtggtgctgttcgtgaccctgagaagacagaagaaggagcccctgatcgtgttcgaggaggaggacgtgagagagaacatcatcacctacgacgacgagggcggcggcgaggaggacaccgaggccttcgacatcgccaccctgcagaaccccgacggcatcaacggcttcatccccagaaaggacatcaagcccgagtaccagtacatgcccagacccggcctgagacccgcccccaacagcgtggacgtggacgacttcatcaacaccagaatccaggaggccgacaacgaccccaccgcccccccctacgacagcatccagatctacggctacgagggcagaggcagcgtggccggcagcctgagcagcctggagagcgccaccaccgacagcgacctggactacgactacctgcagaactggggccccagattcaagaagctggccgacctgtacggcagcaaggacaccttcgacgacgacagctag

SEQ ID NO: 9708 - DNA, 2082 bp, Artificial Sequence
  Description of Artificial Sequence: Synthetic coding sequence
atgaaggagaactactgcctgcaggccgccctggtgtgcctgggcatgctgtgccacagccacgccttcgcccccgagagaagaggccacctgagacccagcttccacggccaccacgagaagggcaaggagggccaggtgctgcagagaagcaagagaggctgggtgtggaaccagttcttcgtgatcgaggagtacaccggccccgaccccgtgctggtgggcagactgcacagcgacatcgacagcggcgacggcaacatcaagtacatcctgagcggcgagggcgccggcaccatcttcgtgatcgacgacaagagcggcaacatccacgccaccaagaccctggacagagaggagagagcccagtacaccctgatggcccaggccgtggacagagacaccaacagacccctggagccccccagcgagttcatcgtgaaggtgcaggacatcaacgacaacccccccgagttcctgcacgagacctaccacgccaacgtgcccgagagaagcaacgtgggcaccagcgtgatccaggtgaccgccagcgacgccgacgaccccacctacggcaacagcgccaagctggtgtacagcatcctggagggccagccctacttcagcgtggaggcccagaccggcatcatcagaaccgccctgcccaacatggacagagaggccaaggaggagtaccacgtggtgatccaggccaaggacatgggcggccacatgggcggcctgagcggcaccaccaaggtgaccatcaccctgaccgacgtgaacgacaacccccccaagttcccccagagcgtgtaccagatgagcgtgagcgaggccgccgtgcccggcgaggaggtgggcagagtgaaggccaaggaccccgacatcggcgagaacggcctggtgacctacaacatcgtggacggcgacggcatggagagcttcgagatcaccaccgactacgagacccaggagggcgtgatcaagctgaagaagcccgtggacttcgagaccaagagagcctacagcctgaaggtggaggccgccaacgtgcacatcgaccccaagttcatcagcaacggccccttcaaggacaccgtgaccgtgaagatcagcgtggaggacgccgacgagccccccatgttcctggcccccagctacatccacgaggtgcaggagaacgccgccgccggcaccgtggtgggcagagtgcacgccaaggaccccgacgccgccaacagccccatcagatacagcatcgacagacacaccgacctggacagattcttcaccatcaaccccgaggacggcttcatcaagaccaccaagcccctggacagagaggagaccgcctggctgaacatcaccgtgttcgccgccgagatccacaacagacaccaggaggccaaggtgcccgtggccatcagagtgctggacgtgaacgacaacgcccccaagttcgccgccccctacgagggcttcatctgcgagagcgaccagaccaagcccctgagcaaccagcccatcgtgaccatcagcgccgacgacaaggacgacaccgccaacggccccagattcatcttcagcctgccccccgagatcatccacaaccccaacttcaccgtgagagacaacagagacaacaccgccggcgtgtacgccagaagaggcggcttcagcagacagaagcaggacctgtacctgctgcccatcgtgatcagcgacggcggcatcccccccatgagcagcaccaacaccctgaccatcaaggtgtgcggctgcgacgtgaacggcgccctgctgagctgcaacgccgaggcctacatcctgaacgccggcctgagcaccggcgccctgatcgccatcctggcctgcatcgtgatcctgctgggctgccccagcctgatggagccccccagccccagagaggacatgagactgctgtacctgggcttccagctgatgctgttcagctacgtgaaggtgaacagaagattctgcctgctgggcgtgttcatcaagctgcccttcctgtacgtggtggccaccgagagccccaccaccctgaccagcctgtag

SEQ ID NO: 9709 - DNA, 516 bp, Artificial Sequence
  Description of Artificial Sequence: Synthetic coding sequence
atgaaggagaactactgcctgcaggccgccctggtgtgcctgggcatgctgtgccacagccacgccttcgcccccgagagaagaggccacctgagacccagcttccacggccaccacgagaagggcaaggagggccaggtgctgcagagaagcaagagaggctgggtgtggaaccagttcttcgtgatcgaggagtacaccggccccgaccccgtgctggtgggcagactgcacagcgacatcgacagcggcgacggcaacatcaagtacatcctgagcggcgagggcgccggcaccatcttcgtgatcgacgacaagagcggcaacatccacgccaccaagaccctggacagagaggagagagcccagtacaccctgatggcccaggccgtggacagagacaccaacagaaacagcctgagcagaagcagaaccctgatgaccaccctgagaagcagctgcaccagacccatcatgcccacctgcctgagaggccccatgtgggtgagaacctag

SEQ ID NO: 9710 - DNA, 2340 bp, Artificial Sequence
  Description of Artificial Sequence: Synthetic coding sequence
atgggccccggcctggccgccagaagactgagaccccccagcagagcccccgagatcaccgtgttcagcgcccagagaccctgcgacatccccagctgctgccacctgctgagcgaccagagcgacggctggagcgtgctgcagaagctggccgccagcatccagtgggtgaagaagctgcacagcgacatcgacagcggcgacggcaacatcaagtacatcctgagcggcgagggcgccggcaccatcttcgtgatcgacgacaagagcggcaacatccacgccaccaagaccctggacagagaggagagagcccagtacaccctgatggcccaggccgtggacagagacaccaacagacccctggagccccccagcgagttcatcgtgaaggtgcaggacatcaacgacaacccccccgagttcctgcacgagacctaccacgccaacgtgcccgagagaagcaacgtgggcaccagcgtgatccaggtgaccgccagcgacgccgacgaccccacctacggcaacagcgccaagctggtgtacagcatcctggagggccagccctacttcagcgtggaggcccagaccggcatcatcagaaccgccctgcccaacatggacagagaggccaaggaggagtaccacgtggtgatccaggccaaggacatgggcggccacatgggcggcctgagcggcaccaccaaggtgaccatcaccctgaccgacgtgaacgacaacccccccaagttcccccagagcgtgtaccagatgagcgtgagcgaggccgccgtgcccggcgaggaggtgggcagagtgaaggccaaggaccccgacatcggcgagaacggcctggtgacctacaacatcgtggacggcgacggcatggagagcttcgagatcaccaccgactacgagacccaggagggcgtgatcaagctgaagaagcccgtggacttcgagaccaagagagcctacagcctgaaggtggaggccgccaacgtgcacatcgaccccaagttcatcagcaacggccccttcaaggacaccgtgaccgtgaagatcagcgtggaggacgccgacgagccccccatgttcctggcccccagctacatccacgaggtgcaggagaacgccgccgccggcaccgtggtgggcagagtgcacgccaaggaccccgacgccgccaacagccccatcagatacagcatcgacagacacaccgacctggacagattcttcaccatcaaccccgaggacggcttcatcaagaccaccaagcccctggacagagaggagaccgcctggctgaacatcaccgtgttcgccgccgagatccacaacagacaccaggaggccaaggtgcccgtggccatcagagtgctggacgtgaacgacaacgcccccaagttcgccgccccctacgagggcttcatctgcgagagcgaccagaccaagcccctgagcaaccagcccatcgtgaccatcagcgccgacgacaaggacgacaccgccaacggccccagattcatcttcagcctgccccccgagatcatccacaaccccaacttcaccgtgagagacaacagagacaacaccgccggcgtgtacgccagaagaggcggcttcagcagacagaagcaggacctgtacctgctgcccatcgtgatcagcgacggcggcatcccccccatgagcagcaccaacaccctgaccatcaaggtgtgcggctgcgacgtgaacggcgccctgctgagctgcaacgccgaggcctacatcctgaacgccggcctgagcaccggcgccctgatcgccatcctggcctgcatcgtgatcctgctggtgatcgtggtgctgttcgtgaccctgagaagacagaagaaggagcccctgatcgtgttcgaggaggaggacgtgagagagaacatcatcacctacgacgacgagggcggcggcgaggaggacaccgaggccttcgacatcgccaccctgcagaaccccgacggcatcaacggcttcatccccagaaaggacatcaagcccgagtaccagtacatgcccagacccggcctgagacccgcccccaacagcgtggacgtggacgacttcatcaacaccagaatccaggaggccgacaacgaccccaccgcccccccctacgacagcatccagatctacggctacgagggcagaggcagcgtggccggcagcctgagcagcctggagagcgccaccaccgacagcgacctggactacgactacctgcagaactggggccccagattcaagaagctggccgacctgtacggcagcaaggacaccttcgacgacgacagctag

SEQ ID NO: 9711 - DNA, 528 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaagatgaagatctggcaggtgctgtgcctggccagatggctgacctag

SEQ ID NO: 9712 - DNA, 2142 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaaggtggtggacagcgacagacccgagagaagcaagttcagactgaccggcaagggcgtggaccaggagcccaagggcatcttcagaatcaacgagaacaccggcagcgtgagcgtgaccagaaccctggacagagaggtgatcgccgtgtaccagctgttcgtggagaccaccgacgtgaacggcaagaccctggagggccccgtgcccctggaggtgatcgtgatcgaccagaacgacaacagacccatcttcagagagggcccctacatcggccacgtgatggagggcagccccaccggcaccaccgtgatgagaatgaccgccttcgacgccgacgaccccgccaccgacaacgccctgctgagatacaacatcagacagcagacccccgacaagcccagccccaacatgttctacatcgaccccgagaagggcgacatcgtgaccgtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcctgtag

SEQ ID NO: 9713 - DNA, 2283 bp, Artificial Sequence
  Description of Artificial Sequence: Synthetic coding sequence
atgaagaccccccccggcgccagcagcagaaccaagtgcagcagagagctgagaagcttctgcgccttcagctgccccagagccaagcagcccacctgcaccgcctggttcccccagcaggagcaccccagcgagaacggcccccagatgcccggcagagacccccccgccgccagcaccatgcaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaaggtggtggacagcgacagacccgagagaagcaagttcagactgaccggcaagggcgtggaccaggagcccaagggcatcttcagaatcaacgagaacaccggcagcgtgagcgtgaccagaaccctggacagagaggtgatcgccgtgtaccagctgttcgtggagaccaccgacgtgaacggcaagaccctggagggccccgtgcccctggaggtgatcgtgatcgaccagaacgacaacagacccatcttcagagagggcccctacatcggccacgtgatggagggcagccccaccggcaccaccgtgatgagaatgaccgccttcgacgccgacgaccccgccaccgacaacgccctgctgagatacaacatcagacagcagacccccgacaagcccagccccaacatgttctacatcgaccccgagaagggcgacatcgtgaccgtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9714 - DNA, 2142 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaaggtggtggacagcgacagacccgagagaagcaagttcagactgaccggcaagggcgtggaccaggagcccaagggcatcttcagaatcaacgagaacaccggcagcgtgagcgtgaccagaaccctggacagagaggtgatcgccgtgtaccagctgttcgtggagaccaccgacgtgaacggcaagaccctggagggccccgtgcccctggaggtgatcgtgatcgaccagaacgacaacagacccatcttcagagagggcccctacatcggccacgtgatggagggcagccccaccggcaccaccgtgatgagaatgaccgccttcgacgccgacgaccccgccaccgacaacgccctgctgagatacaacatcagacagcagacccccgacaagcccagccccaacatgttctacatcgaccccgagaagggcgacatcgtgaccgtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9715 - DNA, 573 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggacatcttcaagttcgccagaaccagccccgtgcccagacagaagagaagcatcgtggtgagccccatcctgatccccgagaaccagagacagcccttccccagagacgtgggcaagagaacccacaaccccatcaacagcgagctgctgctgaacgagggcatcaccgccgacctgaacccctgcatcaccatcctggccatctag

SEQ ID NO: 9716 - DNA, 528 bp, Artificial Sequence; identical to SEQ ID NO: 9711
  Description of Artificial Sequence: Synthetic coding sequence

SEQ ID NO: 9717 - DNA, 2025 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaccagagcatcctgaacctgaccttcagcgactgcaagggcaacgacaagctgagatacgaggtgagcagcccctacttcaaggtgaacagcgacggcggcctggtggccctgagaaacatcaccgccgtgggcaagaccctgttcgtgcacgccagaaccccccacgccgaggacatggccgagctggtgatcgtgggcggcaaggacatccagggcagcctgcaggtggtggacagcgacagacccgagagaagcaagttcagactgaccggcaagggcgtggaccaggagcccaagggcatcttcagaatcaacgagaacaccggcagcgtgagcgtgaccagaaccctggacagagaggtgatcgccgtgtaccagctgttcgtggagaccaccgacgtgaacggcaagaccctggagggccccgtgcccctggaggtgatcgtgatcgaccagaacgacaacagacccatcttcagagagggcccctacatcggccacgtgatggagggcagccccaccggcaccaccgtgatgagaatgaccgccttcgacgccgacgaccccgccaccgacaacgccctgctgagatacaacatcagacagcagacccccgacaagcccagccccaacatgttctacatcgaccccgagaagggcgacatcgtgaccgtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9718 - DNA, 1248 bp, Artificial Sequence
  Description of Artificial Sequence: Synthetic coding sequence
atgcagcccagaacccccctggtgctgtgcgtgctgctgagccaggtggccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9719 - DNA, 819 bp, Artificial Sequence
  Description of Artificial Sequence: Synthetic coding sequence
atgcagcccagaacccccctggtgctgtgcgtgctgctgagccaggtgctgctgctgaccagcgccgaggacctggactgcacccccggcttccagcagaaggtgttccacatcaaccagcccgccgagttcatcgaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcaagtag

SEQ ID NO: 9720 - DNA, 1212 bp, Artificial Sequence
  Description of Artificial Sequence: Synthetic coding sequence
gtggtgagccccgccctgctggacagagagaccctggagaaccccaagtacgagctgatcatcgaggcccaggacatggccggcctggacgtgggcctgaccggcaccgccaccgccaccatcatgatcgacgacaagaacgaccacagccccaagttcaccaagaaggagttccaggccaccgtggaggagggcgccgtgggcgtgatcgtgaacctgaccgtggaggacaaggacgaccccaccaccggcgcctggagagccgcctacaccatcatcaacggcaaccccggccagagcttcgagatccacaccaacccccagaccaacgagggcatgctgagcgtggtgaagcccctggactacgagatcagcgccttccacaccctgctgatcaaggtggagaacgaggaccccctggtgcccgacgtgagctacggccccagcagcaccgccaccgtgcacatcaccgtgctggacgtgaacgagggccccgtgttctaccccgaccccatgatggtgaccagacaggaggacctgagcgtgggcagcgtgctgctgaccgtgaacgccaccgaccccgacagcctgcagcaccagaccatcagatacagcgtgtacaaggaccccgccggctggctgaacatcaaccccatcaacggcaccgtggacaccaccgccgtgctggacagagagagccccttcgtggacaacagcgtgtacaccgccctgttcctggccatcgacagcggcaacccccccgccaccggcaccggcaccctgctgatcaccctggaggacgtgaacgacaacgcccccttcatctaccccaccgtggccgaggtgtgcgacgacgccaagaacctgagcgtggtgatcctgggcgccagcgacaaggacctgcaccccaacaccgaccccttcaagttcgagatccacaagcaggccgtgcccgacaaggtgtggaagatcagcaagatcaacaacacccacgccctggtgagcctgctgcagaacctgaacaaggccaactacaacctgcccatcatggtgaccgacagcggcaagccccccatgaccaacatcaccgacctgagagtgcaggtgtgcagctgcagaaacagcaaggtggactgcaacgccgccggcgccctgagattcagcctgcccagcgtgctgctgctgagcctgttcagcctggcctgcctgtag

SEQ ID NO: 9721 - DNA, 2721 bp, Artificial Sequence
  Description of Artificial Sequence: Synthetic coding sequence
atgtgcagaatcgccggcgccctgagaaccctgctgcccctgctggccgccctgctgcaggccagcgtggaggccagcggcgagatcgccctgtgcaagaccggcttccccgaggacgtgtacagcgccgtgctgagcaaggacgtgcacgagggccagcccctgctgaacgtgaagttcagcaactgcaacggcaagagaaaggtgcagtacgagagcagcgagcccgccgacttcaaggtggacgaggacggcatggtgtacgccgtgagaagcttccccctgagcagcgagcacgccaagttcctgatctacgcccaggacaaggagacccaggagaagtggcaggtggccgtgaagctgagcctgaagcccaccctgaccgaggagagcgtgaaggagagcgccgaggtggaggagatcgtgttccccagacagttcagcaagcacagcggccacctgcagagacagaagagagactgggtgatcccccccatcaacctgcccgagaacagcagaggccccttcccccaggagctggtgagaatcagaagcgacagagacaagaacctgagcctgagatacagcgtgaccggccccggcgccgaccagccccccaccggcatcttcatcatcaaccccatcagcggccagctgagcgtgaccaagcccctggacagagagcagatcgccagattccacctgagagcccacgccgtggacatcaacggcaaccaggtggagaaccccatcgacatcgtgatcaacgtgatcgacatgaacgacaacagacccgagttcctgcaccaggtgtggaacggcaccgtgcccgagggcagcaagcccggcacctacgtgatgaccgtgaccgccatcgacgccgacgaccccaacgccctgaacggcatgctgagatacagaatcgtgagccaggcccccagcacccccagccccaacatgttcaccatcaacaacgagaccggcgacatcatcaccgtggccgccggcctggacagagagaaggtgcagcagtacaccctgatcatccaggccaccgacatggagggcaaccccacctacggcctgagcaacaccgccaccgccgtgatcaccgtgaccgacgtgaacgacaacccccccgagttcaccgccatgaccttctacggcgaggtgcccgagaacagagtggacatcatcgtggccaacctgaccgtgaccgacaaggaccagccccacacccccgcctggaacgccgtgtacagaatcagcggcggcgaccccaccggcagattcgccatccagaccgaccccaacagcaacgacggcctggtgaccgtggtgaagcccatcgacttcgagaccaacagaatgttcgtgctgaccgtggccgccgagaaccaggtgcccctggccaagggcatccagcaccccccccagagcaccgccaccgtgagcgtgaccgtgatcgacgtgaacgagaacccctacttcgcccccaaccccaagatcatcagacaggaggagggcctgcacgccggcaccatgctgaccaccttcaccgcccaggaccccgacagatacatgcagcagaacatcagatacaccaagctgagcgaccccgccaactggctgaagatcgaccccgtgaacggccagatcaccaccatcgccgtgctggacagagagagccccaacgtgaagaacaacatctacaacgccaccttcctggccagcgacaacggcatcccccccatgagcggcaccggcaccctgcagatctacctgctggacatcaacgacaacgccccccaggtgctgccccaggaggccgagacctgcgagacccccgaccccaacagcatcaacatcaccgccctggactacgacatcgaccccaacgccggccccttcgccttcgacctgcccctgagccccgtgaccatcaagagaaactggaccatcaccagactgaacggcgacttcgcccagctgaacctgaagatcaagttcctggaggccggcatctacgaggtgcccatcatcatcaccgacagcggcaacccccccaagagcaacatcagcatcctgagagtgaaggtgtgccagtgcgacagcaacggcgactgcaccgacgtggacagaatcgtgggcgccggcctgggcaccggcgccatcatcgccatcctgctgtgcatcatcatcctgctgatcctggtgctgatgttcgtggtgtggatgaagagaagagacaaggagagacaggccaagcagctgctgatcgaccccgaggacgacgtgagagacaacatcctgaagtacgacgaggagggcggcggcgaggaggaccaggactacgacctgagccagctgcagcagcccgacaccgtggagcccgacgccatcaagcccgtgggcatcagaagaatggacgagagacccatccacgccgagccccagtaccccgtgagaagcgccgccccccaccccggcgacatcggcgacttcatcaacgagggcctgaaggccgccgacaacgaccccaccgcccccccctacgacagcctgctggtgttcgactacgagggcagcggcagcaccgccggcagcctgagcagcctgaacagcagcagcagcggcggcgagcaggactacgactacctgaacgactggggccccagattcaagaagctggccgacatgtacggcggcggcgacgactag

SEQ ID NO: 9722 - DNA, 2628 bp, Artificial Sequence
  Description of Artificial Sequence: Synthetic coding sequence
atgttcctgctgagaagatacgtgtgcatcttcaccgagaagctgaagaaccaggccgagctgtacgtgttcctgagcgtgaagttcagcaactgcaacggcaagagaaaggtgcagtacgagagcagcgagcccgccgacttcaaggtggacgaggacggcatggtgtacgccgtgagaagcttccccctgagcagcgagcacgccaagttcctgatctacgcccaggacaaggagacccaggagaagtggcaggtggccgtgaagctgagcctgaagcccaccctgaccgaggagagcgtgaaggagagcgccgaggtggaggagatcgtgttccccagacagttcagcaagcacagcggccacctgcagagacagaagagagactgggtgatcccccccatcaacctgcccgagaacagcagaggccccttcccccaggagctggtgagaatcagaagcgacagagacaagaacctgagcctgagatacagcgtgaccggccccggcgccgaccagccccccaccggcatcttcatcatcaaccccatcagcggccagctgagcgtgaccaagcccctggacagagagcagatcgccagattccacctgagagcccacgccgtggacatcaacggcaaccaggtggagaaccccatcgacatcgtgatcaacgtgatcgacatgaacgacaacagacccgagttcctgcaccaggtgtggaacggcaccgtgcccgagggcagcaagcccggcacctacgtgatgaccgtgaccgccatcgacgccgacgaccccaacgccctgaacggcatgctgagatacagaatcgtgagccaggcccccagcacccccagccccaacatgttcaccatcaacaacgagaccggcgacatcatcaccgtggccgccggcctggacagagagaaggtgcagcagtacaccctgatcatccaggccaccgacatggagggcaaccccacctacggcctgagcaacaccgccaccgccgtgatcaccgtgaccgacgtgaacgacaacccccccgagttcaccgccatgaccttctacggcgaggtgcccgagaacagagtggacatcatcgtggccaacctgaccgtgaccgacaaggaccagccccacacccccgcctggaacgccgtgtacagaatcagcggcggcgaccccaccggcagattcgccatccagaccgaccccaacagcaacgacggcctggtgaccgtggtgaagcccatcgacttcgagaccaacagaatgttcgtgctgaccgtggccgccgagaaccaggtgcccctggccaagggcatccagcaccccccccagagcaccgccaccgtgagcgtgaccgtgatcgacgtgaacgagaacccctacttcgcccccaaccccaagatcatcagacaggaggagggcctgcacgccggcaccatgctgaccaccttcaccgcccaggaccccgacagatacatgcagcagaacatcagatacaccaagctgagcgaccccgccaactggctgaagatcgaccccgtgaacggccagatcaccaccatcgccgtgctggacagagagagccccaacgtgaagaacaacatctacaacgccaccttcctggccagcgacaacggcatcccccccatgagcggcaccggcaccctgcagatctacctgctggacatcaacgacaacgccccccaggtgctgccccaggaggccgagacctgcgagacccccgaccccaacagcatcaacatcaccgccctggactacgacatcgaccccaacgccggccccttcgccttcgacctgcccctgagccccgtgaccatcaagagaaactggaccatcaccagactgaacggcgacttcgcccagctgaacctgaagatcaagttcctggaggccggcatctacgaggtgcccatcatcatcaccgacagcggcaacccccccaagagcaacatcagcatcctgagagtgaaggtgtgccagtgcgacagcaacggcgactgcaccgacgtggacagaatcgtgggcgccggcctgggcaccggcgccatcatcgccatcctgctgtgcatcatcatcctgctgatcctggtgctgatgttcgtggtgtggatgaagagaagagacaaggagagacaggccaagcagctgctgatcgaccccgaggacgacgtgagagacaacatcctgaagtacgacgaggagggcggcggcgaggaggaccaggactacgacctgagccagctgcagcagcccgacaccgtggagcccgacgccatcaagcccgtgggcatcagaagaatggacgagagacccatccacgccgagccccagtaccccgtgagaagcgccgccccccaccccggcgacatcggcgacttcatcaacgagggcctgaaggccgccgacaacgaccccaccgcccccccctacgacagcctgctggtgttcgactacgagggcagcggcagcaccgccggcagcctgagcagcctgaacagcagcagcagcggcggcgagcaggactacgactacctgaacgactggggccccagattcaagaagctggccgacatgtacggcggcggcgacgactag

SEQ ID NO: 9723 - DNA, 2355 bp, Artificial Sequence
  Description of Artificial Sequence: Synthetic coding sequence
atgcagagactgatgatgctgctggccaccagcggcgcctgcctgggcctgctggccgtggccgccgtggccgccgccggcgccaaccccgcccagagagacacccacagcctgctgcccacccacagaagacagaagagagactggatctggaaccagatgcacatcgacgaggagaagaacaccagcctgccccaccacgtgggcaagatcaagagcagcgtgagcagaaagaacgccaagtacctgctgaagggcgagtacgtgggcaaggtgttcagagtggacgccgagaccggcgacgtgttcgccatcgagagactggacagagagaacatcagcgagtaccacctgaccgccgtgatcgtggacaaggacaccggcgagaacctggagacccccagcagcttcaccatcaaggtgcacgacgtgaacgacaactggcccgtgttcacccacagactgttcaacgccagcgtgcccgagagcagcgccgtgggcaccagcgtgatcagcgtgaccgccgtggacgccgacgaccccaccgtgggcgaccacgccagcgtgatgtaccagatcctgaagggcaaggagtacttcgccatcgacaacagcggcagaatcatcaccatcaccaagagcctggacagagagaagcaggccagatacgagatcgtggtggaggccagagacgcccagggcctgagaggcgacagcggcaccgccaccgtgctggtgaccctgcaggacatcaacgacaacttccccttcttcacccagaccaagtacaccttcgtggtgcccgaggacaccagagtgggcaccagcgtgggcagcctgttcgtggaggaccccgacgagccccagaacagaatgaccaagtacagcatcctgagaggcgactaccaggacgccttcaccatcgagaccaaccccgcccacaacgagggcatcatcaagcccatgaagcccctggactacgagtacatccagcagtacagcttcatcgtggaggccaccgaccccaccatcgacctgagatacatgagcccccccgccggcaacagagcccaggtgatcatcaacatcaccgacgtggacgagccccccatcttccagcagcccttctaccacttccagctgaaggagaaccagaagaagcccctgatcggcaccgtgctggccatggaccccgacgccgccagacacagcatcggctacagcatcagaagaaccagcgacaagggccagttcttcagagtgaccaagaagggcgacatctacaacgagaaggagctggacagagaggtgtacccctggtacaacctgaccgtggaggccaaggagctggacagcaccggcacccccaccggcaaggagagcatcgtgcaggtgcacatcgaggtgctggacgagaacgacaacgcccccgagttcgccaagccctaccagcccaaggtgtgcgagaacgccgtgcacggccagctggtgctgcagatcagcgccatcgacaaggacatcacccccagaaacgtgaagttcaagttcatcctgaacaccgagaacaacttcaccctgaccgacaaccacgacaacaccgccaacatcaccgtgaagtacggccagttcgacagagagcacaccaaggtgcacttcctgcccgtggtgatcagcgacaacggcatgcccagcagaaccggcaccagcaccctgaccgtggccgtgtgcaagtgcaacgagcagggcgagttcaccttctgcgaggacatggccgcccaggtgggcgtgagcatccaggccgtggtggccatcctgctgtgcatcctgaccatcaccgtgatcaccctgctgatcttcctgagaagaagactgagaaagcaggccagagcccacggcaagagcgtgcccgagatccacgagcagctggtgacctacgacgaggagggcggcggcgagatggacaccaccagctacgacgtgagcgtgctgaacagcgtgagaagaggcggcgccaagccccccagacccgccctggacgccagacccagcctgtacgcccaggtgcagaagccccccagacacgcccccggcgcccacggcggccccggcgagatggccgccatgatcgaggtgaagaaggacgaggccgaccacgacggcgacggccccccctacgacaccctgcacatctacggctacgagggcagcgagagcatcgccgagagcctgagcagcctgggcaccgacagcagcgacagcgacgtggactacgacttcctgaacgactggggccccagattcaagatgctggccgagctgtacggcagcgaccccagagaggagctgctgtactag

SEQ ID NO: 9724 - DNA, 2010 bp, Artificial Sequence
  Description of Artificial Sequence: Synthetic coding sequence
atgcagagactgatgatgctgctggccaccagcggcgcctgcctgggcctgctggccgtggccgccgtggccgccgccggcgccaaccccgcccagagagacacccacagcctgctgcccacccacagaagacagaagagagactggatctggaaccagatgcacatcgacgaggagaagaacaccagcctgccccaccacgtgggcaagatcaagagcagcgtgagcagaaagaacgccaagtacctgctgaagggcgagtacgtgggcaaggtgttcagagtggacgccgagaccggcgacgtgttcgccatcgagagactggacagagagaacatcagcgagtaccacctgaccgccgtgatcgtggacaaggacaccggcgagaacctggagacccccagcagcttcaccatcaaggtgcacgacgtgaacgacaactggcccgtgttcacccacagactgttcaacgccagcgtgcccgagagcagcgccgtgggcaccagcgtgatcagcgtgaccgccgtggacgccgacgaccccaccgtgggcgaccacgccagcgtgatgtaccagatcctgaagggcaaggagtacttcgccatcgacaacagcggcagaatcatcaccatcaccaagagcctggacagagagaagcaggccagatacgagatcgtggtggaggccagagacgcccagggcctgagaggcgacagcggcaccgccaccgtgctggtgaccctgcaggacatcaacgacaacttccccttcttcacccagaccaagtacaccttcgtggtgcccgaggacaccagagtgggcaccagcgtgggcagcctgttcgtggaggaccccgacgagccccagaacagaatgaccaagtacagcatcctgagaggcgactaccaggacgccttcaccatcgagaccaaccccgcccacaacgagggcatcatcaagcccatgaagcccctggactacgagtacatccagcagtacagcttcatcgtggaggccaccgaccccaccatcgacctgagatacatgagcccccccgccggcaacagagcccaggtgatcatcaacatcaccgacgtggacgagccccccatcttccagcagcccttctaccacttccagctggtgctgcagatcagcgccatcgacaaggacatcacccccagaaacgtgaagttcaagttcatcctgaacaccgagaacaacttcaccctgaccgacaaccacgacaacaccgccaacatcaccgtgaagtacggccagttcgacagagagcacaccaaggtgcacttcctgcccgtggtgatcagcgacaacggcatgcccagcagaaccggcaccagcaccctgaccgtggccgtgtgcaagtgcaacgagcagggcgagttcaccttctgcgaggacatggccgcccaggtgggcgtgagcatccaggccgtggtggccatcctgctgtgcatcctgaccatcaccgtgatcaccctgctgatcttcctgagaagaagactgagaaagcaggccagagcccacggcaagagcgtgcccgagatccacgagcagctggtgacctacgacgaggagggcggcggcgagatggacaccaccagctacgacgtgagcgtgctgaacagcgtgagaagaggcggcgccaagccccccagacccgccctggacgccagacccagcctgtacgcccaggtgcagaagccccccagacacgcccccggcgcccacggcggccccggcgagatggccgccatgatcgaggtgaagaaggacgaggccgaccacgacggcgacggccccccctacgacaccctgcacatctacggctacgagggcagcgagagcatcgccgagagcctgagcagcctgggcaccgacagcagcgacagcgacgtggactacgacttcctgaacgactggggccccagattcaagatgctggccgagctgtacggcagcgaccccagagaggagctgctgtactag

SEQ ID NO: 9725 - DNA, 672 bp, Artificial Sequence
  Description of Artificial Sequence: Synthetic coding sequence
atgcccagcagaaccggcaccagcaccctgaccgtggccgtgtgcaagtgcaacgagcagggcgagttcaccttctgcgaggacatggccgcccaggtgggcgtgagcatccaggccgtggtggccatcctgctgtgcatcctgaccatcaccgtgatcaccctgctgatcttcctgagaagaagactgagaaagcaggccagagcccacggcaagagcgtgcccgagatccacgagcagctggtgacctacgacgaggagggcggcggcgagatggacaccaccagctacgacgtgagcgtgctgaacagcgtgagaagaggcggcgccaagccccccagacccgccctggacgccagacccagcctgtacgcccaggtgcagaagccccccagacacgcccccggcgcccacggcggccccggcgagatggccgccatgatcgaggtgaagaaggacgaggccgaccacgacggcgacggccccccctacgacaccctgcacatctacggctacgagggcagcgagagcatcgccgagagcctgagcagcctgggcaccgacagcagcgacagcgacgtggactacgacttcctgaacgactggggccccagattcaagatgctggccgagctgtacggcagcgaccccagagaggagctgctgtactag

SEQ ID NO: 9726 - DNA, 1578 bp, Artificial Sequence
  Description of Artificial Sequence: Synthetic coding sequence
atgcccagcacctgcagcaaggagaacatgtgggccagaagcagcggcagcatgcagagacaggagacctgcagccccctgagagcccagaacagaatgaccaagtacagcatcctgagaggcgactaccaggacgccttcaccatcgagaccaaccccgcccacaacgagggcatcatcaagcccatgaagcccctggactacgagtacatccagcagtacagcttcatcgtggaggccaccgaccccaccatcgacctgagatacatgagcccccccgccggcaacagagcccaggtgatcatcaacatcaccgacgtggacgagccccccatcttccagcagcccttctaccacttccagctgaaggagaaccagaagaagcccctgatcggcaccgtgctggccatggaccccgacgccgccagacacagcatcggctacagcatcagaagaaccagcgacaagggccagttcttcagagtgaccaagaagggcgacatctacaacgagaaggagctggacagagaggtgtacccctggtacaacctgaccgtggaggccaaggagctggacagcaccggcacccccaccggcaaggagagcatcgtgcaggtgcacatcgaggtgctggacgagaacgacaacgcccccgagttcgccaagccctaccagcccaaggtgtgcgagaacgccgtgcacggccagctggtgctgcagatcagcgccatcgacaaggacatcacccccagaaacgtgaagttcaagttcatcctgaacaccgagaacaacttcaccctgaccgacaaccacgacaacaccgccaacatcaccgtgaagtacggccagttcgacagagagcacaccaaggtgcacttcctgcccgtggtgatcagcgacaacggcatgcccagcagaaccggcaccagcaccctgaccgtggccgtgtgcaagtgcaacgagcagggcgagttcaccttctgcgaggacatggccgcccaggtgggcgtgagcatccaggccgtggtggccatcctgctgtgcatcctgaccatcaccgtgatcaccctgctgatcttcctgagaagaagactgagaaagcaggccagagcccacggcaagagcgtgcccgagatccacgagcagctggtgacctacgacgaggagggcggcggcgagatggacaccaccagctacgacgtgagcgtgctgaacagcgtgagaagaggcggcgccaagccccccagacccgccctggacgccagacccagcctgtacgcccaggtgcagaagccccccagacacgcccccggcgcccacggcggccccggcgagatggccgccatgatcgaggtgaagaaggacgaggccgaccacgacggcgacggccccccctacgacaccctgcacatctacggctacgagggcagcgagagcatcgccgagagcctgagcagcctgggcaccgacagcagcgacagcgacgtggactacgacttcctgaacgactggggccccagattcaagatgctggccgagctgtacggcagcgaccccagagaggagctgctgtactag

SEQ ID NO: 9727 - DNA, 2373 bp, Artificial Sequence
  Description of Artificial Sequence: Synthetic coding sequence
atgagaacctacagatacttcctgctgctgttctgggtgggccagccctaccccaccctgagcacccccctgagcaagagaaccagcggcttccccgccaagaagagagccctggagctgagcggcaacagcaagaacgagctgaacagaagcaagagaagctggatgtggaaccagttcttcctgctggaggagtacaccggcagcgactaccagtacgtgggcaagctgcacagcgaccaggacagaggcgacggcagcctgaagtacatcctgagcggcgacggcgccggcgacctgttcatcatcaacgagaacaccggcgacatccaggccaccaagagactggacagagaggagaagcccgtgtacatcctgagagcccaggccatcaacagaagaaccggcagacccgtggagcccgagagcgagttcatcatcaagatccacgacatcaacgacaacgagcccatcttcaccaaggaggtgtacaccgccaccgtgcccgagatgagcgacgtgggcaccttcgtggtgcaggtgaccgccaccgacgccgacgaccccacctacggcaacagcgccaaggtggtgtacagcatcctgcagggccagccctacttcagcgtggagagcgagaccggcatcatcaagaccgccctgctgaacatggacagagagaacagagagcagtaccaggtggtgatccaggccaaggacatgggcggccagatgggcggcctgagcggcaccaccaccgtgaacatcaccctgaccgacgtgaacgacaacccccccagattcccccagagcacctaccagttcaagacccccgagagcagcccccccggcacccccatcggcagaatcaaggccagcgacgccgacgtgggcgagaacgccgagatcgagtacagcatcaccgacggcgagggcctggacatgttcgacgtgatcaccgaccaggagacccaggagggcatcatcaccgtgaagaagctgctggacttcgagaagaagaaggtgtacaccctgaaggtggaggccagcaacccctacgtggagcccagattcctgtacctgggccccttcaaggacagcgccaccgtgagaatcgtggtggaggacgtggacgagccccccgtgttcagcaagctggcctacatcctgcagatcagagaggacgcccagatcaacaccaccatcggcagcgtgaccgcccaggaccccgacgccgccagaaaccccgtgaagtacagcgtggacagacacaccgacatggacagaatcttcaacatcgacagcggcaacggcagcatcttcaccagcaagctgctggacagagagaccctgctgtggcacaacatcaccgtgatcgccaccgagatcaacaaccccaagcagagcagcagagtgcccctgtacatcaaggtgctggacgtgaacgacaacgcccccgagttcgccgagttctacgagaccttcgtgtgcgagaaggccaaggccgaccagctgatccagaccctgcacgccgtggacaaggacgacccctacagcggccaccagttcagcttcagcctggcccccgaggccgccagcggcagcaacttcaccatccaggacaacaaggacaacaccgccggcatcctgaccagaaagaacggctacaacagacacgagatgagcacctacctgctgcccgtggtgatcagcgacaacgactaccccgtgcagagcagcaccggcaccgtgaccgtgagagtgtgcgcctgcgaccaccacggcaacatgcagagctgccacgccgaggccctgatccaccccaccggcctgagcaccggcgccctggtggccatcctgctgtgcatcgtgatcctgctggtgaccgtggtgctgttcgccgccctgagaagacagagaaagaaggagcccctgatcatcagcaaggaggacatcagagacaacatcgtgagctacaacgacgagggcggcggcgaggaggacacccaggccttcgacatcggcaccctgagaaaccccgaggccatcgaggacaacaagctgagaagagacatcgtgcccgaggccctgttcctgcccagaagaacccccaccgccagagacaacaccgacgtgagagacttcatcaaccagagactgaaggagaacgacaccgaccccaccgcccccccctacgacagcctggccacctacgcctacgagggcaccggcagcgtggccgacagcctgagcagcctggagagcgtgaccaccgacgccgaccaggactacgactacctgagcgactggggccccagattcaagaagctggccgacatgtacggcggcgtggacagcgacaaggacagctag

SEQ ID NO: 9728 - DNA, 576 bp, Artificial Sequence
  Description of Artificial Sequence: Synthetic coding sequence
atgggcggcagcggcagcagactgagcaaggagctgctggccgagtaccaggacctgaccttcctgaccaagcaggagatcctgctggcccacagaagattctgcgagctgctgccccaggagcagagaagcgtggagagcagcctgagagcccaggtgcccttcgagcagatcctgagcctgcccgagctgaaggccaaccccttcaaggagagaatctgcagagtgttcagcaccagccccgccaaggacagcctgagcttcgaggacttcctggacctgctgagcgtgttcagcgacaccgccacccccgacatcaagagccactacgccttcagaatcttcgacttcgacgacgacggcaccctgaacagagaggacctgagcagactggtgaactgcctgaccggcgagggcgaggacaccagactgagcgccagcgagatgaagcagctgatcgacaacatcctggaggagagcgacatcgacagagacggcaccatcaacctgagcgagttccagcacgtgatcagcagaagccccgacttcgccagcagcttcaagatcgtgctgtag

SEQ ID NO: 9729 - DNA, 237 bp, Artificial Sequence
  Description of Artificial Sequence: Synthetic coding sequence
atgagcgaggtgctgccctacggcgacgagaagctgagcccctacggcgacggcggcgacgtgggccagatcttcagctgcagactgcaggacaccaacaacttcttcggcgccggccagaacaagagaccccccaagctgggccagatcggcagaagcaagagagtggtgatcgaggacgacagaatcgacgacgtgctgaagaacatgaccgacaaggccccccccggcgtgtag

SEQ ID NO: 9730 - DNA, 1563 bp, Artificial Sequence
  Description of Artificial Sequence: Synthetic coding sequence
atggagggcggccccgccgtgtgctgccaggaccccagagccgagctggtggagagagtggccgccatcgacgtgacccacctggaggaggccgacggcggccccgagcccaccagaaacggcgtggaccccccccccagagccagagccgccagcgtgatccccggcagcaccagcagactgctgcccgccagacccagcctgagcgccagaaagctgagcctgcaggagagacccgccggcagctacctggaggcccaggccggcccctacgccaccggccccgccagccacatcagccccagagcctggagaagacccaccatcgagagccaccacgtggccatcagcgacgccgaggactgcgtgcagctgaaccagtacaagctgcagagcgagatcggcaagggcgcctacggcgtggtgagactggcctacaacgagagcgaggacagacactacgccatgaaggtgctgagcaagaagaagctgctgaagcagtacggcttccccagaagacccccccccagaggcagccaggccgcccagggcggccccgccaagcagctgctgcccctggagagagtgtaccaggagatcgccatcctgaagaagctggaccacgtgaacgtggtgaagctgatcgaggtgctggacgaccccgccgaggacaacctgtacctggccctgcagaaccaggcccagaacatccagctggacagcaccaacatcgccaagccccacagcctgctgcccagcgagcagcaggacagcggcagcacctgggccgccagaagcgtgttcgacctgctgagaaagggccccgtgatggaggtgccctgcgacaagcccttcagcgaggagcaggccagactgtacctgagagacgtgatcctgggcctggagtacctgcactgccagaagatcgtgcacagagacatcaagcccagcaacctgctgctgggcgacgacggccacgtgaagatcgccgacttcggcgtgagcaaccagttcgagggcaacgacgcccagctgagcagcaccgccggcacccccgccttcatggcccccgaggccatcagcgacagcggccagagcttcagcggcaaggccctggacgtgtgggccaccggcgtgaccctgtactgcttcgtgtacggcaagtgccccttcatcgacgacttcatcctggccctgcacagaaagatcaagaacgagcccgtggtgttccccgaggagcccgagatcagcgaggagctgaaggacctgatcctgaagatgctggacaagaaccccgagaccagaatcggcgtgcccgacatcaagctgcacccctgggtgaccaagaacggcgaggagcccctgcccagcgaggaggagcactgcagcgtggtggaggtgaccgaggaggaggtgaagaacagcgtgagactgatccccagctggaccaccgtgatcctggtgaagagcatgctgagaaagagaagcttcggcaaccccttcgagccccaggccagaagagaggagagaagcatgagcgcccccggcaacctgctggtgtag

SEQ ID NO: 9731 - DNA, 1518 bp, Artificial Sequence
  Description of Artificial Sequence: Synthetic coding sequence
atggagggcggccccgccgtgtgctgccaggaccccagagccgagctggtggagagagtggccgccatcgacgtgacccacctggaggaggccgacggcggccccgagcccaccagaaacggcgtggaccccccccccagagccagagccgccagcgtgatccccggcagcaccagcagactgctgcccgccagacccagcctgagcgccagaaagctgagcctgcaggagagacccgccggcagctacctggaggcccaggccggcccctacgccaccggccccgccagccacatcagccccagagcctggagaagacccaccatcgagagccaccacgtggccatcagcgacgccgaggactgcgtgcagctgaaccagtacaagctgcagagcgagatcggcaagggcgcctacggcgtggtgagactggcctacaacgagagcgaggacagacactacgccatgaaggtgctgagcaagaagaagctgctgaagcagtacggcttccccagaagacccccccccagaggcagccaggccgcccagggcggccccgccaagcagctgctgcccctggagagagtgtaccaggagatcgccatcctgaagaagctggaccacgtgaacgtggtgaagctgatcgaggtgctggacgaccccgccgaggacaacctgtacctggtgttcgacctgctgagaaagggccccgtgatggaggtgccctgcgacaagcccttcagcgaggagcaggccagactgtacctgagagacgtgatcctgggcctggagtacctgcactgccagaagatcgtgcacagagacatcaagcccagcaacctgctgctgggcgacgacggccacgtgaagatcgccgacttcggcgtgagcaaccagttcgagggcaacgacgcccagctgagcagcaccgccggcacccccgccttcatggcccccgaggccatcagcgacagcggccagagcttcagcggcaaggccctggacgtgtgggccaccggcgtgaccctgtactgcttcgtgtacggcaagtgccccttcatcgacgacttcatcctggccctgcacagaaagatcaagaacgagcccgtggtgttccccgaggagcccgagatcagcgaggagctgaaggacctgatcctgaagatgctggacaagaaccccgagaccagaatcggcgtgcccgacatcaagctgcacccctgggtgaccaagaacggcgaggagcccctgcccagcgaggaggagcactgcagcgtggtggaggtgaccgaggaggaggtgaagaacagcgtgagactgatccccagctggaccaccgtgatcctggtgaagagcatgctgagaaagagaagcttcggcaaccccttcgagccccaggccagaagagaggagagaagcatgagcgcccccggcaacctgctggtgaaggagggcttcggcgagggcggcaagagccccgagctgcccggcgtgcaggaggacgaggccgccagctag

SEQ ID NO: 9732 - DNA, 1599 bp, Artificial Sequence
  Description of Artificial Sequence: Synthetic coding sequence
atgcagttcggcaagctgtggtgcggctgcagcggcgagttccccaccagactgagaagaagaacccccctgaccgaggccatggagggcggccccgccgtgtgctgccaggaccccagagccgagctggtggagagagtggccgccatcgacgtgacccacctggaggaggccgacggcggccccgagcccaccagaaacggcgtggaccccccccccagagccagagccgccagcgtgatccccggcagcaccagcagactgctgcccgccagacccagcctgagcgccagaaagctgagcctgcaggagagacccgccggcagctacctggaggcccaggccggcccctacgccaccggccccgccagccacatcagccccagagcctggagaagacccaccatcgagagccaccacgtggccatcagcgacgccgaggactgcgtgcagctgaaccagtacaagctgcagagcgagatcggcaagggcgcctacggcgtggtgagactggcctacaacgagagcgaggacagacactacgccatgaaggtgctgagcaagaagaagctgctgaagcagtacggcttccccagaagacccccccccagaggcagccaggccgcccagggcggccccgccaagcagctgctgcccctggagagagtgtaccaggagatcgccatcctgaagaagctggaccacgtgaacgtggtgaagctgatcgaggtgctggacgaccccgccgaggacaacctgtacctggtgttcgacctgctgagaaagggccccgtgatggaggtgccctgcgacaagcccttcagcgaggagcaggccagactgtacctgagagacgtgatcctgggcctggagtacctgcactgccagaagatcgtgcacagagacatcaagcccagcaacctgctgctgggcgacgacggccacgtgaagatcgccgacttcggcgtgagcaaccagttcgagggcaacgacgcccagctgagcagcaccgccggcacccccgccttcatggcccccgaggccatcagcgacagcggccagagcttcagcggcaaggccctggacgtgtgggccaccggcgtgaccctgtactgcttcgtgtacggcaagtgccccttcatcgacgacttcatcctggccctgcacagaaagatcaagaacgagcccgtggtgttccccgaggagcccgagatcagcgaggagctgaaggacctgatcctgaagatgctggacaagaaccccgagaccagaatcggcgtgcccgacatcaagctgcacccctgggtgaccaagaacggcgaggagcccctgcccagcgaggaggagcactgcagcgtggtggaggtgaccgaggaggaggtgaagaacagcgtgagactgatccccagctggaccaccgtgatcctggtgaagagcatgctgagaaagagaagcttcggcaaccccttcgagccccaggccagaagagaggagagaagcatgagcgcccccggcaacctgctggtgaaggagggcttcggcgagggcggcaagagccccgagctgcccggcgtgcaggaggacgaggccgccagctag

SEQ ID NO: 9733 - DNA, 1632 bp, Artificial Sequence
  Description of Artificial Sequence: Synthetic coding sequence
atggagggcggccccgccgtgtgctgccaggaccccagagccgagctggtggagagagtggccgccatcgacgtgacccacctggaggaggccgacggcggccccgagcccaccagaaacggcgtggaccccccccccagagccagagccgccagcgtgatccccggcagcaccagcagactgctgcccgccagacccagcctgagcgccagaaagctgagcctgcaggagagacccgccggcagctacctggaggcccaggccggcccctacgccaccggccccgccagccacatcagccccagagcctggagaagacccaccatcgagagccaccacgtggccatcagcgacgccgaggactgcgtgcagctgaaccagtacaagctgcagagcgagatcggcaagggcgcctacggcgtggtgagactggcctacaacgagagcgaggacagacactacgccatgaaggtgctgagcaagaagaagctgctgaagcagtacggcttccccagaagacccccccccagaggcagccaggccgcccagggcggccccgccaagcagctgctgcccctggagagagtgtaccaggagatcgccatcctgaagaagctggaccacgtgaacgtggtgaagctgatcgaggtgctggacgaccccgccgaggacaacctgtacctggccctgcagaaccaggcccagaacatccagctggacagcaccaacatcgccaagccccacagcctgctgcccagcgagcagcaggacagcggcagcacctgggccgccagaagcgtgttcgacctgctgagaaagggccccgtgatggaggtgccctgcgacaagcccttcagcgaggagcaggccagactgtacctgagagacgtgatcctgggcctggagtacctgcactgccagaagatcgtgcacagagacatcaagcccagcaacctgctgctgggcgacgacggccacgtgaagatcgccgacttcggcgtgagcaaccagttcgagggcaacgacgcccagctgagcagcaccgccggcacccccgccttcatggcccccgaggccatcagcgacagcggccagagcttcagcggcaaggccctggacgtgtgggccaccggcgtgaccctgtactgcttcgtgtacggcaagtgccccttcatcgacgacttcatcctggccctgcacagaaagatcaagaacgagcccgtggtgttccccgaggagcccgagatcagcgaggagctgaaggacctgatcctgaagatgctggacaagaaccccgagaccagaatcggcgtgcccgacatcaagctgcacccctgggtgaccaagaacggcgaggagcccctgcccagcgaggaggagcactgcagcgtggtggaggtgaccgaggaggaggtgaagaacagcgtgagactgatccccagctggaccaccgtgatcctggtgaagagcatgctgagaaagagaagcttcggcaaccccttcgagccccaggccagaagagaggagagaagcatgagcgcccccggcaacctgctggtgaaggagggcttcggcgagggcggcaagagccccgagctgcccggcgtgcaggaggacgaggccgccagctag

SEQ ID NO: 9734 - DNA, 1695 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagggcgaggagaagggcaccaaggtgcaggccaagagagagaagctgcaggaggacaagcccaccttcaagaaggaggagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9735 - DNA, 2382 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccaggtggaggtgatggtggaggagaagaccaccgagagccaggaggagaccgtggtgatgagcctgaagaacggccagatcagcagcgaggagcccaagcaggaggaggagagagagcagggcagcgacgagatcagccaccacgagaagatggaggaggaggacaaggagagagccgaggccgagagagccagactggaggccgaggagagagagagaatcaaggccgagcaggacaagaagatcgccgacgagagagccagaatcgaggccgaggagaaggccgccgcccaggagagagagagaagagaggccgaggagagagagagaatgagagaggaggagaagagagccgccgaggagagacagagaatcaaggaggaggagaagagagccgccgaggagagacagagaatcaaggaggaggagaagagagccgccgaggagagacagagaatcaaggaggaggagaagagagccgccgaggagagacagagagccagagccgaggaggaggagaaggccaaggtggaggagcagaagagaaacaagcagctggaggagaagaagcacgccatgcaggagaccaagatcaagggcgagaaggtggagcagaagatcgagggcaagtgggtgaacgagaagaaggcccaggaggacaagctgcagaccgccgtgctgaagaagcagggcgaggagaagggcaccaaggtgcaggccaagagagagaagctgcaggaggacaagcccaccttcaagaaggaggagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9736 - DNA, 1617 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9737 - DNA, 1677 bp, Artificial Sequence
  Description of Artificial Sequence: Synthetic coding sequence
atgctgggcggcagcggcagccacggcagaagaagcctggccgccctgagccagatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagggcgaggagaagggcaccaaggtgcaggccaagagagagaagctgcaggaggacaagcccaccttcaagaaggaggagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9738 - DNA, 1617 bp, Artificial Sequence; identical to SEQ ID NO: 9736
  Description of Artificial Sequence: Synthetic coding sequence

SEQ ID NO: 9739 - DNA, 1692 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagggcgaggagaagggcaccaaggtgcaggccaagagagagaagctgcaggaggacaagcccaccttcaagaaggaggagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9740 - DNA, 1599 bp, Artificial Sequence
  Description of Artificial Sequence: Synthetic coding sequence
atgctgggcggcagcggcagccacggcagaagaagcctggccgccctgagccagatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9741 - DNA, 528 bp, Artificial Sequence
  Description of Artificial Sequence: Synthetic coding sequence
atgcccgaggacggcctgagcgacgacaagaagcccttcaagtgcttcacccccaagggcagcagcctgaagatcgaggagagagccgagttcctgaacaagagcgtgcagaagagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcctgaccttctgcagcagcctgttcggcctgtggctgatcggcaacctgctgctgctgcccagcttcctgcccctgctgcccgagtgggtgttcctgtag

SEQ ID NO: 9742 - DNA, 219 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaactag

SEQ ID NO: 9743 - DNA, 1380 bp, Artificial Sequence
  Description of Artificial Sequence: Synthetic coding sequence
atggacgacttcgagagaagaagagagctgagaagacagaagagagaggagatgagactggaggccgagagaatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagctag

SEQ ID NO: 9744 - DNA, 219 bp, Artificial Sequence; identical to SEQ ID NO: 9742
  Description of Artificial Sequence: Synthetic coding sequence

SEQ ID NO: 9745 - DNA, 1632 bp, Artificial Sequence
  Description of Artificial Sequence: Synthetic coding sequence
atgaccagctacatgaaggtggacagacagtggaacgccgagatcctggagctgatcctgggcaccggccagctgagcaccggccagatcgcctaccagagaaacgacgacgacgaggaggaggccgccagagagagaagaagaagagccagacaggagagactgagacagaagcaggaggaggagagcctgggccaggtgaccgaccaggtggaggtgaacgcccagaacagcgtgcccgacgaggaggccaagaccaccaccaccaacacccaggtggagggcgacgacgaggccgccttcctggagagactggccagaagagaggagagaagacagaagagactgcaggaggccctggagagacagaaggagttcgaccccaccatcaccgacgccagcctgagcctgcccagcagaagaatgcagaacgacaccgccgagaacgagaccaccgagaaggaggagaagagcgagagcagacaggagagatacgagatcgaggagaccgagaccgtgaccaagagctaccagaagaacgactggagagacgccgaggagaacaagaaggaggacaaggagaaggaggaggaggaggaggagaagcccaagagaggcagcatcggcgagaaccagatcaaggacgagaagatcaagaaggacaaggagcccaaggaggaggtgaagagcttcatggacagaaagaagggcttcaccgaggtgaagagccagaacggcgagttcatgacccacaagctgaagcacaccgagaacaccttcagcagacccggcggcagagccagcgtggacaccaaggaggccgagggcgccccccaggtggaggccggcaagagactggaggagctgagaagaagaagaggcgagaccgagagcgaggagttcgagaagctgaagcagaagcagcaggaggccgccctggagctggaggagctgaagaagaagagagaggagagaagaaaggtgctggaggaggaggagcagagaagaaagcaggaggaggccgacagaaagctgagagaggaggaggagaagagaagactgaaggaggagatcgagagaagaagagccgaggccgccgagaagagacagaagatgcccgaggacggcctgagcgacgacaagaagcccttcaagtgcttcacccccaagggcagcagcctgaagatcgaggagagagccgagttcctgaacaagagcgtgcagaagagcagcggcgtgaagagcacccaccaggccgccatcgtgagcaagatcgacagcagactggagcagtacaccagcgccatcgagggcaccaagagcgccaagcccaccaagcccgccgccagcgacctgcccgtgcccgccgagggcgtgagaaacatcaagagcatgtgggagaagggcaacgtgttcagcagccccaccgccgccggcacccccaacaaggagaccgccggcctgaaggtgggcgtgagcagcagaatcaacgagtggctgaccaagacccccgacggcaacaagagccccgcccccaagcccagcgacctgagacccggcgacgtgagcagcaagagaaacctgtgggagaagcagagcgtggacaaggtgaccagccccaccaaggtgtag

SEQ ID NO: 9746 - DNA, 3975 bp, Artificial Sequence
  Description of Artificial Sequence: Synthetic coding sequence
atggccgacagcctgtacaacatcagactgctgagagagttcagcaacgagtacctgaacaagtgcttctacctgaccctggaggacatgctgtacgcccccctggtgctgaagcccaacgtgatggtgttcatcgccgagctgttctggtggttcgagaacgtgaagcccgacttcgtgcagcccagagacgtgcaggagctgaaggacgccaagaccgtgctgcaccagaagagcagcagaccccccgtgcccatcagcaacgccaccaagagaagcttcctgggcagccccgccgccggcaccctggccgagctgcagccccccgtgcagctgcccgccgagggctgccacagacactacctgcaccccgaggagcccgagtacctgggcaagggcaccgccgccttcagccccagccaccccctgctgcccctgagacagaagcagcagaagagcatccagggcgaggacatccccgaccagagacacagaagcaacagcctgaccagagtggacggccagcccagaggcgccgccatcgcctggcccgagaagaagaccagacccgccagccagcccacccccttcgccctgcaccacgccgccagctgcgaggtggaccccagcagcggcgacagcatcagcctggccagaagcatcagcaaggacagcctggccagcaacatcgtgaacctgaccccccagaaccagccccaccccaccgccaccaagagccacggcaagagcctgctgagcaacgtgagcatcgaggacgaggaggaggagctggtggccatcgtgagagccgacgtggtgccccagcaggccgaccccgagttccccagagccagccccagagccctgggcctgaccgccaacgccagaagcccccagggccagctggacaccagcgagagcaagcccgacagcttcttcctggagcccctgatgcccgccgtgctgaagcccgccaaggagaagcaggtgatcaccaaggaggacgagagaggcgagggcagacccagaagcatcgtgagcagaagacccagcgagggcccccagcccctggtgagaagaaagatgaccggcagcagagacctgaacagaaccttcacccccatcccctgcagcgagttccccatgggcatcgaccccaccgagaccggccccctgagcgtggagaccgccggcgaggtgtgcggcggccccctggccctgggcggcttcgaccccttcccccagggccccagcaccgacggcttcttcctgcacgtgggcagagccgacgaggacaccgagggcagactgtacgtgagctgcagcaagagccccaacagccacgacagcgagccctggaccctgctgagacaggacagcgacagcgacgtggtggacatcgaggaggccgagcacgacttcatgggcgaggcccaccccgtggtgttcagcagatacatcggcgaggaggagagcgccaagctgcaggaggacatgaaggtgaaggagcacgaggacaaggacgacgccagcggcagaagcagcccctgcctgagcaccgccagccagatgagcagcgtgagcatggccagcggcagcgtgaagatgaccagcttcgccgagagaaagctgcagagactgaacagctgcgagaccaagagcagcaccagcagcagccagaagaccacccccgacgccagcgagagctgccccgcccccctgaccacctggagacagaagagagagcagagccccagccagcacggcaaggaccccgccagcctgctggccagcgagctggtgcagctgcacatgcagctggaggagaagagaagagccatcgaggcccagaagaagaagatggaggccctgagcgccagacagagactgaagctgggcaaggccgccttcctgcacgtggtgaagaagggcaaggccgaggccgccccccccctgagacccgagcacttcgccaaggagtacagccagcacaacggcgaggactgcggcgacgccgtgagcaagaccgaggacttcctggtgaaggaggagcagagagaggagctgctgcacgagccccaggacgtggacaaggagagcctggccttcgcccagcagcacaaggccaaggaccccgtggccctgcacgagctggagagaaacaaggtgatcagcgccgccctgctggaggacaccgtgggcgaggtggtggacgtgaacgagtgcgacctgagcatcgagaagctgaacgagaccatcagcaccctgcagcaggccatcctgaagatcagccagcagcaggagcagctgctgatgaagagccccaccgtgcccgtgcccggcagcaagaacaacagccaggaccacaaggtgaaggcccccgtgcacttcgtggagcccctgagccccaccggcgtggccggccacagaaaggcccccagactgggccagggcagaaacagcagaagcggcagacccgccgagctgaaggtgcccaaggacagaccccagggcagcagcagaagcaagacccccacccccagcgtggagaccctgccccacctgagacccttccccgccagcagccaccccagaacccccaccgaccccggcctggacagcgccctggagcccagcggcgacccccacggcaagtgcctgttcgacagctacagactgcacgacgagagcaaccagagaaccctgaccctgagcagcagcaaggacgccaacatcctgagcgagcagatgagcctgaaggaggtgctggacgccagcgtgaaggaggtgggcagcagcagcagcgacgtgagcggcaaggagagcgtgcccgtggaggagcccctgagaagcagagccagcctgatcgaggtggacctgagcgacctgaaggcccccgacgaggacggcgagctggtgagcctggacggcagcgccgacctggtgagcgagggcgaccagaagcccggcgtgggcttcttcttcaaggacgagcagaaggccgaggacgagctggccaagaagagagccgccttcctgctgaagcagcagagaaaggccgaggaggccagagtgagaaagcagcagctggaggccgaggtggagctgaagagagacgaggccagaagaaaggccgaggaggacagagtgagaaaggaggaggagaaggccagaagagagctgatcaagcaggagtacctgagaagaaagcagcagcagatcctggaggagcagggcctgggcaagcccaagagcaagcccaagaagcccagacccaagagcgtgcacagagaggagagctgcagcgacagcggcaccaagtgcagcagcacccccgacaacctgagcagaacccagagcggcagcagcctgagcctggccagcgccgccaccaccgagcccgagagcgtgcacagcggcggcacccccagccagagagtggagagcatggaggccctgcccatcctgagcagaaaccccagcagaagcaccgacagagactgggagaccgccagcgccgccagcagcctggccagcgtggccgagtacaccggccccaagctgttcaaggagcccagcagcaagagcaacaagcccatcatccacaacgccatcagccactgctgcctggccggcaaggtgaacgagccccacaagaacagcatcctggaggagctggagaagtgcgacgccaaccactacatcatcctgttcagagacgccggctgccagttcagagccctgtactgctactaccccgacaccgaggagatctacaagctgaccggcaccggccccaagaacatcaccaagaagatgatcgacaagctgtacaagtacagcagcgacagaaagcagttcaacctgatccccgccaagaccatgagcgtgagcgtggacgccctgaccatccacaaccacctgtggcagcccaagagacccgccgtgcccaagaaggcccagaccagaaagtag

SEQ ID NO: 9747 - DNA, 4809 bp, Artificial Sequence
  Description of Artificial Sequence: Synthetic coding sequence
atggtggacgccagcggcagagccgccgccgagggctggagaaagatggaggccccccccgacggcgccgccgacctggtgcccctggacagatacgacgccgccagagccaagatcgccgccaacctgcagtggatctgcgccaaggcctacggcagagacaacatccccgaggacctgagagaccccttctacgtggaccagtacgagcaggagcacatcaagccccccgtgatcaagctgctgctgagcagcgagctgtactgcagagtgtgcagcctgatcctgaagggcgaccaggtggccgccctgcagggccaccagagcgtgatccaggccctgagcagaaagggcatctacgtgatggagagcgacgacacccccgtgaccgagagcgacctgagcagagcccccatcaagatgagcgcccacatggccatggtggacgccctgatgatggcctacaccgtggagatgatcagcatcgagaaggtggtggccagcgtgaagagattcagcaccttcagcgccagcaaggagctgccctacgacctggaggacgccatggtgttctggatcaacaaggtgaacctgaagatgagagagatcaccgagaaggaggtgaagctgaagcagcagctgctggagagccccgcccaccagaaggtgagatacagaagagagcacctgagcgccagacagagcccctacttccccctgctggaggacctgatgagagacggcagcgacggcgccgccctgctggccgtgatccactactactgccccgagcagatgaagctggacgacatctgcctgaaggaggtgaccagcatggccgacagcctgtacaacatcagactgctgagagagttcagcaacgagtacctgaacaagtgcttctacctgaccctggaggacatgctgtacgcccccctggtgctgaagcccaacgtgatggtgttcatcgccgagctgttctggtggttcgagaacgtgaagcccgacttcgtgcagcccagagacgtgcaggagctgaaggacgccaagaccgtgctgcaccagaagagcagcagaccccccgtgcccatcagcaacgccaccaagagaagcttcctgggcagccccgccgccggcaccctggccgagctgcagccccccgtgcagctgcccgccgagggctgccacagacactacctgcaccccgaggagcccgagtacctgggcaagggcaccgccgccttcagccccagccaccccctgctgcccctgagacagaagcagcagaagagcatccagggcgaggacatccccgaccagagacacagaagcaacagcctgaccagagtggacggccagcccagaggcgccgccatcgcctggcccgagaagaagaccagacccgccagccagcccacccccttcgccctgcaccacgccgccagctgcgaggtggaccccagcagcggcgacagcatcagcctggccagaagcatcagcaaggacagcctggccagcaacatcgtgaacctgaccccccagaaccagccccaccccaccgccaccaagagccacggcaagagcctgctgagcaacgtgagcatcgaggacgaggaggaggagctggtggccatcgtgagagccgacgtggtgccccagcaggccgaccccgagttccccagagccagccccagagccctgggcctgaccgccaacgccagaagcccccagggccagctggacaccagcgagagcaagcccgacagcttcttcctggagcccctgatgcccgccgtgctgaagcccgccaaggagaagcaggtgatcaccaaggaggacgagagaggcgagggcagacccagaagcatcgtgagcagaagacccagcgagggcccccagcccctggtgagaagaaagatgaccggcagcagagacctgaacagaaccttcacccccatcccctgcagcgagttccccatgggcatcgaccccaccgagaccggccccctgagcgtggagaccgccggcgaggtgtgcggcggccccctggccctgggcggcttcgaccccttcccccagggccccagcaccgacggcttcttcctgcacgtgggcagagccgacgaggacaccgagggcagactgtacgtgagctgcagcaagagccccaacagccacgacagcgagccctggaccctgctgagacaggacagcgacagcgacgtggtggacatcgaggaggccgagcacgacttcatgggcgaggcccaccccgtggtgttcagcagatacatcggcgaggaggagagcgccaagctgcaggaggacatgaaggtgaaggagcacgaggacaaggacgacgccagcggcagaagcagcccctgcctgagcaccgccagccagatgagcagcgtgagcatggccagcggcagcgtgaagatgaccagcttcgccgagagaaagctgcagagactgaacagctgcgagaccaagagcagcaccagcagcagccagaagaccacccccgacgccagcgagagctgccccgcccccctgaccacctggagacagaagagagagcagagccccagccagcacggcaaggaccccgccagcctgctggccagcgagctggtgcagctgcacatgcagctggaggagaagagaagagccatcgaggcccagaagaagaagatggaggccctgagcgccagacagagactgaagctgggcaaggccgccttcctgcacgtggtgaagaagggcaaggccgaggccgccccccccctgagacccgagcacttcgccaaggagtacagccagcacaacggcgaggactgcggcgacgccgtgagcaagaccgaggacttcctggtgaaggaggagcagagagaggagctgctgcacgagccccaggacgtggacaaggagagcctggccttcgcccagcagcacaaggccaaggaccccgtggccctgcacgagctggagagaaacaaggtgatcagcgccgccctgctggaggacaccgtgggcgaggtggtggacgtgaacgagtgcgacctgagcatcgagaagctgaacgagaccatcagcaccctgcagcaggccatcctgaagatcagccagcagcaggagcagctgctgatgaagagccccaccgtgcccgtgcccggcagcaagaacaacagccaggaccacaaggtgaaggcccccgtgcacttcgtggagcccctgagccccaccggcgtggccggccacagaaaggcccccagactgggccagggcagaaacagcagaagcggcagacccgccgagctgaaggtgcccaaggacagaccccagggcagcagcagaagcaagacccccacccccagcgtggagaccctgccccacctgagacccttccccgccagcagccaccccagaacccccaccgaccccggcctggacagcgccctggagcccagcggcgacccccacggcaagtgcctgttcgacagctacagactgcacgacgagagcaaccagagaaccctgaccctgagcagcagcaaggacgccaacatcctgagcgagcagatgagcctgaaggaggtgctggacgccagcgtgaaggaggtgggcagcagcagcagcgacgtgagcggcaaggagagcgtgcccgtggaggagcccctgagaagcagagccagcctgatcgaggtggacctgagcgacctgaaggcccccgacgaggacggcgagctggtgagcctggacggcagcgccgacctggtgagcgagggcgaccagaagcccggcgtgggcttcttcttcaaggacgagcagaaggccgaggacgagctggccaagaagagagccgccttcctgctgaagcagcagagaaaggccgaggaggccagagtgagaaagcagcagctggaggccgaggtggagctgaagagagacgaggccagaagaaaggccgaggaggacagagtgagaaaggaggaggagaaggccagaagagagctgatcaagcaggagtacctgagaagaaagcagcagcagatcctggaggagcagggcctgggcaagcccaagagcaagcccaagaagcccagacccaagagcgtgcacagagaggagagctgcagcgacagcggcaccaagtgcagcagcacccccgacaacctgagcagaacccagagcggcagcagcctgagcctggccagcgccgccaccaccgagcccgagagcgtgcacagcggcggcacccccagccagagagtggagagcatggaggccctgcccatcctgagcagaaaccccagcagaagcaccgacagagactgggagaccgccagcgccgccagcagcctggccagcgtggccgagtacaccggccccaagctgttcaaggagcccagcagcaagagcaacaagcccatcatccacaacgccatcagccactgctgcctggccggcaaggtgaacgagccccacaagaacagcatcctggaggagctggagaagtgcgacgccaaccactacatcatcctgttcagagacgccggctgccagttcagagccctgtactgctactaccccgacaccgaggagatctacaagctgaccggcaccggccccaagaacatcaccaagaagatgatcgacaagctgtacaagtacagcagcgacagaaagcagttcaacctgatccccgccaagaccatgagcgtgagcgtggacgccctgaccatccacaaccacctgtggcagcccaagagacccgccgtgcccaagaaggcccagaccagaaagtag
